United States Patent
Slaymaker et al.

(10) Patent No.: US 11,142,760 B2
(45) Date of Patent: Oct. 12, 2021

(54) COMPOSITIONS AND METHODS FOR TREATING HEMOGLOBINOPATHIES

(71) Applicant: Beam Therapeutics Inc., Cambridge, MA (US)

(72) Inventors: Ian Slaymaker, Cambridge, MA (US); Nicole Gaudelli, Cambridge, MA (US); Yi Yu, Cambridge, MA (US); Bernd Zetsche, Cambridge, MA (US); David A. Born, Cambridge, MA (US); Seung-Joo Lee, Cambridge, MA (US); Michael Packer, Cambridge, MA (US)

(73) Assignee: Beam Therapeutics Inc., Cambridge, MA (US)

(*) Notice: Subject to any disclaimer, the term of this patent is extended or adjusted under 35 U.S.C. 154(b) by 0 days.

(21) Appl. No.: 17/214,461

(22) Filed: Mar. 26, 2021

(65) Prior Publication Data

US 2021/0261955 A1    Aug. 26, 2021

Related U.S. Application Data

(63) Continuation of application No. PCT/US2020/018193, filed on Feb. 13, 2020.

(60) Provisional application No. 62/805,271, filed on Feb. 13, 2019, provisional application No. 62/805,277, filed on Feb. 13, 2019, provisional application No. 62/852,224, filed on May 23, 2019, provisional application No. 62/852,228, filed on May 23, 2019, provisional application No. 62/931,722, filed on Nov. 6, 2019, provisional application No. 62/931,747, filed on Nov. 6, 2019, provisional application No. 62/941,569, filed on Nov. 27, 2019, provisional application No. 62/966,526, filed on Jan. 27, 2020.

(51) Int. Cl.
| | |
|---|---|
| *C12N 15/11* | (2006.01) |
| *C12N 9/22* | (2006.01) |
| *C12N 9/78* | (2006.01) |
| *C07K 14/47* | (2006.01) |
| *C12N 5/078* | (2010.01) |
| *A61K 35/18* | (2015.01) |
| *C12N 15/90* | (2006.01) |

(52) U.S. Cl.
CPC .............. *C12N 15/11* (2013.01); *A61K 35/18* (2013.01); *C07K 14/4717* (2013.01); *C12N 5/0641* (2013.01); *C12N 9/22* (2013.01); *C12N 9/78* (2013.01); *C12N 15/907* (2013.01); *C12Y 305/04004* (2013.01); *C12N 2310/20* (2017.05); *C12N 2510/00* (2013.01)

(58) Field of Classification Search
CPC .................................................... C12N 15/11
See application file for complete search history.

(56) References Cited

U.S. PATENT DOCUMENTS

| | | | |
|---|---|---|---|
| 2013/0109048 A1 | 5/2013 | Giugliano et al. |
| 2016/0201089 A1 | 7/2016 | Gersbach et al. |
| 2017/0152528 A1 | 6/2017 | Zhang |
| 2018/0216095 A1 | 8/2018 | Thanos et al. |
| 2018/0289832 A1 | 10/2018 | Hartigan et al. |
| 2018/0312828 A1 | 11/2018 | Liu et al. |
| 2019/0144558 A1 | 5/2019 | Pearse et al. |
| 2019/0169639 A1 | 6/2019 | Zhang et al. |
| 2020/0399626 A1 | 12/2020 | Liu et al. |
| 2021/0130805 A1 | 5/2021 | Gaudelli et al. |

FOREIGN PATENT DOCUMENTS

| | | |
|---|---|---|
| WO | 2015006498 A2 | 1/2015 |
| WO | 2015089406 A1 | 6/2015 |
| WO | 2016094872 A1 | 6/2016 |
| WO | 2016205711 A1 | 12/2016 |
| WO | 2017011721 A1 | 1/2017 |
| WO | 2017070632 A2 | 4/2017 |
| WO | 2017160890 A1 | 9/2017 |
| WO | 2017165862 A1 | 9/2017 |
| WO | 2018027078 A1 | 2/2018 |
| WO | 2018071868 A1 | 4/2018 |
| WO | 2018142364 A1 | 8/2018 |
| WO | 2018213708 A1 | 11/2018 |
| WO | 2019005884 A1 | 1/2019 |
| WO | 2019079347 A1 | 4/2019 |
| WO | 2019204378 A1 | 10/2019 |
| WO | 2019/217941 | 11/2019 |
| WO | 2019217942 A1 | 11/2019 |
| WO | 2019217943 A1 | 11/2019 |
| WO | 2020028823 A1 | 2/2020 |
| WO | 2020065303 A1 | 4/2020 |
| WO | 2020/168132 | 8/2020 |
| WO | 2020168051 A1 | 8/2020 |

(Continued)

OTHER PUBLICATIONS

Wolf et al., "tadA, an essential tRNA-specific adenosine deaminase from *Escherichia coli*," The EMBO Journal, 2002, vol. 21, No. 14, pp. 3841-3851.

(Continued)

*Primary Examiner* — Scott Long

(74) *Attorney, Agent, or Firm* — Greenberg Traurig, LLP; Melissa Hunter-Ensor; Nicholas R. Ballor

(57) ABSTRACT

The present invention features compositions and methods for editing deleterious mutations associated with hemoglobinopathies, such as sickle cell disease (SCD). In particular embodiments, the invention provides methods for correcting mutations in a beta globin polynucleotide using modified adenosine base editors termed "ABE8" having unprecedented levels (e.g., >60-70%) of efficiency.

30 Claims, 76 Drawing Sheets

Specification includes a Sequence Listing.

(56) References Cited

FOREIGN PATENT DOCUMENTS

| WO | 2020168075 A1 | 8/2020 |
|----|---------------|--------|
| WO | 2021041945 A2 | 3/2021 |

OTHER PUBLICATIONS

Woodcock et al., "Master Protocols to Study Multiple Therapies, Multiple Diseases, or Both," The New England Journal of Medicine, Jul. 6, 2017, vol. 377, No. 1, pp. 62-70.

Yang et al., "Increasing targeting scope of adenosine base editors in mouse and rat embryos through fusion of TadA deaminase with Cas9 variants," Protein & Cell, 2018, vol. 9, No. 9, pp. 814-819.

Yannaki et al., "Hematopoietic Stem Cell Mobilization for Gene Therapy of Adult Patients with Severe β-Thalassemia: Results of Clinical Trials Using G-CSF or Plerixafor in Splenectomized and Nonsplenectomized Subjects," Molecular Therapy, Jan. 2012, vol. 20, No. 1, pp. 230-238.

Yasui et al., "Miscoding Properties of 2'-Deoxyinosine, a Nitric Oxide-Derived DNA Adduct, during Translesion Synthesis Catalyzed by Human DNA Polymerases," Journal of Molecular Biology, Apr. 4, 2008, vol. 377, Iss. 4, pp. 1015-1023.

Yeh et al., "In vivo base editing of post-mitotic sensory cells," Nature Communications, 2018, vol. 9, Article No. 2184, pp. 1-10.

Zafra et al., "Optimized base editors enable efficient editing in cells, organoids and mice," Nature Biotechnology, Oct. 2018, vol. 36, No. 9, pp. 888-893.

Zarrabi et al., "Manipulation of Hematopoietic Stem Cell Fate by Small Molecule Compounds," Stem Cells and Development, 2018, vol. 27, No. 17, pp. 1175-1190.

Zhang et al., "Programmable base editing of zebrafish genome using a modified CRISPR-Cas9 system," Nature Communications, 2017, vol. 8, Article No. 118, pp. 1-5.

Zheng et al., "DNA editing in DNA/RNA hybrids by adenosine deaminases that act on RNA," Nucleic Acids Research, Jan. 28, 2017, vol. 45, No. 6, pp. 3369-3377.

Zhou et al., "Off-target RNA mutation induced by DNA base editing and its elimination by mutagenesis," Nature, 2019, vol. 571, No. 7764, pp. 275-278.

Zonari et al., "Efficient Ex Vivo Engineering and Expansion of Highly Purified Human Hematopoietic Stem and Progenitor Cell Populations for Gene Therapy," Stem Cell Reports, Apr. 11, 2017, vol. 8, No. 4, pp. 977-990.

Zong et al., "Precise base editing in rice, wheat and maize with a Cas9-cytidine deaminase fusion," Nature Biotechnology, 2017, vol. 35, No. 5, pp. 438-440.

Zuo et al., "Cytosine base editor generates substantial off-target single-nucleotide variants in mouse embryos," Science, 2019, vol. 364, No. 6437, pp. 289-292.

Zuris et al., "Cationic lipid-mediated delivery of proteins enables efficient protein-based genome editing in vitro and in vivo," Nature Biotechnology, Jan. 2015, vol. 33, No. 1, pp. 73-80.

International Search Report and Written Opinion issued in corresponding International Patent Application No. PCT/US2020/018193, dated Jul. 20, 2020 (13 pages).

U.S. Appl. No. 17/054,324, filed Nov. 10, 2020.

U.S. Appl. No. 17/054,348, filed Nov. 10, 2020.

U.S. Appl. No. 17/054,424, filed Nov. 10, 2020.

Psatha et al., "Brief Report: A Differential Transcriptomic Profile of Ex Vivo Expanded Adult Human Hematopoietic Stem Cells Empowers Them for Engraftment Better than Their Surface Phenotype," Stem Cells Translational Medicine, 2017, vol. 6, No. 10, pp. 1852-1858, supplemental pp. 1-9.

Psatha et al., "Disruption of the BCL11A Erythroid Enhancer Reactivates Fetal Hemoglobin in Erythroid Cells of Patients with β-Thalassemia Major," Molecular Therapy: Methods & Clinical Development, Sep. 21, 2018, vol. 10, pp. 313-326.

Pule et al., "A Systematic Review of Known Mechanisms of Hydroxyurea-induced Foetal Haemoglobin for Treatment of Sickle Cell Disease," Expert Review of Hematology, 2015, vol. 8, No. 5, pp. 669-679.

Quintana et al., "Control of Treg and TH17 cell differentiation by the aryl hydrocarbon receptor," Nature, 2008, vol. 453, pp. 65-71.

Radtke et al., "A distinct hematopoietic stem cell population for rapid multilineage engraftment in nonhuman primates," Science Translational Medicine, Nov. 1, 2017, vol. 9, No. 414, eaan1145, pp. 1-10.

Rahmig et al., "Improved human erythropoiesis and platelet formation in humanized NSGW41 mice," Stem Cell Reports, 2016, vol. 7, No. 4, pp. 591-601.

Ran et al., "In vivo genome editing using Staphylococcus aureus Cas9," Nature, Apr. 9, 2015, vol. 520, No. 7546, pp. 186-191.

Rees et al., "Analysis and minimization of cellular RNA editing by DNA adenine base editors," Science Advances, 2019, vol. 5, No. 5, eaax5717.

Rees et al., "Improving the DNA specificity and applicability of base editing through protein engineering and protein delivery," Nature Communications, 2017, vol. 8, Article No. 15790, pp. 1-10.

Rees et al., "Sickle-cell disease,"The Lancet, Dec. 11, 2010, vol. 376, Iss. 9757, pp. 2018-2031.

Rees et al., "Base editing: precision chemistry on the genome and transcriptome of living cells," Nature Reviews Genetics, Dec. 2018, vol. 19, No. 12, pp. 770-788.

Rhoda et al., "Interaction of Hemoglobin Siriraj with Hemoglobin S: A Mild Sickle Cell Syndrome," Hemoglobin, 1986, vol. 10, No. 1, pp. 21-31.

Risueno et al., "Identification of T-lymphocytic leukemia-initiating stem cells residing in a small subset of patients with acute myeloid leukemic disease," Blood, 2011, vol. 117, No. 26, pp. 7112-7120.

Rosenski et al., "The RNA Modification Database: 1999 update," Nucleic Acids Research, 1999, vol. 27, No. 1, pp. 196-197.

Rubio et al., "An adenosine-to-inosine tRNA-editing enzyme that can perform C-to-U deamination of DNA," Proceedings of the National Academy of Sciences of the United States of America, May 8, 2007, vol. 104, No. 19, pp. 7821-7826.

Russell et al., "Plerixafor and granulocyte colony-stimulating factor for first-line steady-state autologous peripheral blood stem cell mobilization in lymphoma and multiple myeloma: results of the prospective PREDICT trial," Haematologica, 2013, vol. 98, No. 2, pp. 172-178.

Saechan et al., "Molecular basis and hematological features of hemoglobin variants in Southern Thailand," International Journal of Hematology, 2010, vol. 92, No. 3, pp. 445-450.

Sangkitporn et al., "Hb G Makassar (Beta 6 : Glu-Ala) in a Thai Family," Journal of the Medical Association of Thailand, 2002, vol. 85, No. 5, pp. 577-582.

Sankaran et al., "Anemia: progress in molecular mechanisms and therapies," Nature Medicine, Mar. 2015, vol. 21, No. 3, pp. 221-230.

Saparbaev et al., "Excision of hypoxanthine from DNA containing dIMP residues by the Escherichia coli, yeast, rat, and human alkylpurine DNA glycosylases," Proceedings of the National Academy of Sciences of the United States of America, Jun. 1994, vol. 91, No. 13, pp. 5873-5877.

Satomura et al., "Precise genome-wide base editing by the CRISPR Nickase system in yeast," Scientific Reports, 2017, vol. 7, Article No. 2095, pp. 1-10.

Saville et al., "Efficiencies of platform clinical trials: a vision for the future," Clinical Trials, 2016, vol. 13, No. 3, pp. 358-366.

Scala et al., "Dynamics of genetically engineered hematopoietic stem and progenitor cells after autologous transplantation in humans," Nature Medicine, 2018, vol. 24, pp. 1683-1690, supplemental pp. 1-22.

Schroeder et al., "Mobilization of allogeneic peripheral blood stem cell donors with intravenous plerixafor mobilizes a unique graft," Blood, May 11, 2017, vol. 129, No. 19, pp. 2680-2692.

Shi et al., "Structural basis for targeted DNA cytosine deamination and mutagenesis by APOBEC3A and APOBEC3B," Nature Structural & Molecular Biology, Feb. 2017, vol. 24, No. 2, pp. 131-139.

(56) References Cited

OTHER PUBLICATIONS

Shmakov et al., "Discovery and Functional Characterization of Diverse Class 2 CRISPR-Cas Systems," Molecular Cell, Nov. 5, 2015, vol. 60, No. 3, pp. 385-397.
Stemcell Technologies, "Human Hematopoietic Stem and Progenitor Cell Phenotypes, Frequencies and Hierarchies," STEMCELL Technologies, 2016, Document No. 27034, Version 1.0.0, 1 page.
Strocchio et al., "Treosulfan-based conditioning regimen for allogeneic haematopoietic stem cell transplantation in children with sickle cell disease," British Journal of Haematology, 2015, vol. 169, No. 5, pp. 726-736.
Sundd et al., "Pathophysiology of Sickle Cell Disease," Annual Review of Pathology: Mechanisms of Disease, 2019, vol. 14, pp. 263-292.
Tajer et al., "Ex vivo expansion of hematopoietic stem cells for therapeutic purposes: lessons from development and the niche," Cells, 2019, vol. 8, Iss. 2, Article No. 169, pp. 1-15.
Tang et al., "Aptazyme-embedded guide RNAs enable ligand-responsive genome editing and transcriptional activation," Nature Communications, 2017, vol. 8, Article No. 15939, pp. 1-8.
Townsend et al., "Role of HFE in iron metabolism, hereditary haemochromatosis, anaemia of chronic disease, and secondary iron overload," The Lancet, Mar. 2, 2002, vol. 359, Iss. 9308, pp. 786-790.
Trakarnsanga et al., "An immortalized adult human erythroid line facilitates sustainable and scalable generation of functional red cells," Nature Communications, 2017, vol. 8, Article No. 14750, pp. 1-7, supplemental pp. 1-15.
Trakarnsanga et al., "Induction of adult levels of β-globin in human erythroid cells that intrinsically express embryonic or fetal globin by transduction with KLF1 and BCL11A-XL," Haematologica, 2014, vol. 99, No. 11, pp. 1677-1685.
Traxler et al., "A genome-editing strategy to treat B-hemoglobinopathies that recapitulates a mutation associated with a benign genetic condition," Nature Medicine, Sep. 2016, vol. 22, No. 9, pp. 987-990, supplemental pp. 1-9.
Treisman et al., "Specific transcription and RNA splicing defects in five cloned -thalassaemia genes," Nature, Apr. 14, 1983, vol. 302, pp. 591-596.
Tsai et al., "CIRCLE-seq: a highly sensitive in vitro screen for genome-wide CRISPR-Cas9 nuclease off-targets," Nature Methods, 2017, vol. 14, No. 6, pp. 607-614.
Tsai et al., "GUIDE-seq enables genome-wide profiling of off-target cleavage by CRISPR-Cas nucleases," Nature Biotechnology, Feb. 2015, vol. 33, No. 2, pp. 187-197.
Uchida et al., "High-Efficiency Lentiviral Transduction of Human CD34+ Cells in High-Density Culture with Poloxamer and Prostaglandin E2," Molecular Therapy: Methods & Clinical Development, 2019, vol. 13, pp. 187-196.
Uchida et al., "Serum-free Erythroid Differentiation for Efficient Genetic Modification and High-Level Adult Hemoglobin Production," Molecular Therapy: Methods & Clinical Development, 2018, vol. 9, pp. 247-256.
Valdmanis et al., "A mutation that creates a pseudoexon in SOD1 causes familial ALS," Annals of Human Genetics, Nov. 2009, vol. 73, Pt. 6, pp. 652-657.
Vichinsky et al., "A phase 3 randomized trial of voxelotor in sickle cell disease," The New England Journal of Medicine, 2019, vol. 381, No. 6, pp. 509-519.
Vik et al., "Endonuclease V cleaves at inosines in RNA," Nature Communications, 2013, vol. 4, Article No. 2271, pp. 1-7.
Viprakasit et al., "Hb G-MAKASSAR [β6(A3)Glu—Ala; CODON 6 (G a G-G C G)]: Molecular Characterization, Clinical, and Hematological Effects," Hemoglobin, 2002, vol. 26, No. 3, pp. 245-253.
Wang et al., "Hematopoietic stem cell transplant into non-myeloablated W/Wv mice to detect steady-state engraftment defects," Methods in Molecular Biology, 2008, vol. 430, pp. 171-181.
Weatherall, David J., "The Role of the Inherited Disorders of Hemoglobin, the First "Molecular Diseases," in the Future of Human Genetics," The Annual Review of Genomics and Human Genetics, 2013, vol. 14, pp. 1-24.
Wienert et al., "KLF1 drives the expression of fetal hemoglobin in British HPFH," Blood, Aug. 10, 2017, vol. 130, No. 6, pp. 803-807.
Wilburn et al., "The Prevalence and Role of Hemoglobin Variants in Biometric Screening of a Multiethnic Population: One Large Health System's Experience," American Journal of Clinical Pathology, Jun. 2017, vol. 147, Iss. 6, pp. 589-595.
Wilkinson et al., "Long-term ex vivo haematopoietic-stem-cell expansion allows nonconditioned transplantation," Nature, 2019, vol. 571, pp. 117-121.
Wognum et al., "Mini-Review: Hematopoietic Stem and Progenitor Cells," Stem Cell, Apr. 2015, Document No. 29068, Version 6 0.0, pp. 1-10.
Gaudelli et al., "Directed Evolution of Adenine Base Editors with Increased Activity and Therapeutic Application," bioRxiv, 2020, pp. 1-37.
Gaudelli et al., "Programmable base editing of A-T to G-C in genomic DNA without DNA cleavage," Nature, Nov. 23, 2017, vol. 551, pp. 464-471.
George et al., "Adenosine Deaminases Acting on RNA, RNA Editing, and Interferon Action," Journal of Interferon & Cytokine Research, 2011, vol. 31, No. 1, pp. 99-117.
Gerber et al., "An Adenosine Deaminase that Generates Inosine at the Wobble Position of tRNAs," Science, Nov. 5, 1999, vol. 286, No. 5442, p. 1146 1149.
Geu-Flores et al., "USER fusion: a rapid and efficient method for simultaneous fusion and cloning of multiple PCR products," Nucleic Acids Research, Mar. 27, 2007, vol. 35, No. 7, e55, pp. 1-6.
Giralt et al., "Optimizing autologous stem cell mobilization strategies to improve patient outcomes: consensus guidelines and recommendations," Biology of Blood and Marrow Transplantation, 2014, vol. 20, No. 3, pp. 295-308.
Gluckman et al., "Sickle cell disease: an international survey of results of HLA-identical sibling hematopoietic stem cell transplantation," Blood, 2017, vol. 129, No. 11, pp. 1548-1556.
Goldstein et al., "In Situ Modification of Tissue Stem and Progenitor Cell Genomes," Cell Reports, Apr. 23, 2019, vol. 27, No. 4, pp. 1254-1264, e1-e7, supplemental pp. 1-11.
Grevet et al., "Domain-focused CRISPR screen identifies HRI as a fetal hemoglobin regulator in human erythroid cells," Science, Jul. 20, 2018, vol. 361, No. 6399, pp. 285-290.
Grunebaum et al., "Recent advances in understanding and managing adenosine deaminase and purine nucleoside phosphorylase deficiencies," Current Opinion in Allergy and Clinical Immunology, Dec. 2013, vol. 13, Iss. 6, pp. 630-638.
Grunewald et al., "CRISPR DNA base editors with reduced RNA off-target and self-editing activities," Nature Biotechnology, Sep. 2019, vol. 37, No. 9, pp. 1041-1048.
Grunewald et al., "Transcriptome-wide off-target RNA editing induced by CRISPR-guided DNA base editors," Nature, 2019, vol. 569, No. 7756, pp. 433-437.
Guiu et al., "Tracing the origin of adult intestinal stem cells," Nature, 2019, vol. 570, pp. 107-111, supplemental pp. 1-25.
Haubner et al., "Coexpression profile of leukemic stem cell markers for combinatorial targeted therapy in AML," Leukemia, 2019, vol. 33, pp. 64-74.
Hawksworth et al., "Enhancement of red blood cell transfusion compatibility using CRISPR-mediated erythroblast gene editing," EMBO Molecular Medicine, 2018, vol. 10, No. 6, e8454, pp. 1-11.
Hirose et al., "Immortalization of Erythroblasts by c-MYC and BCL-XL Enables Large-Scale Erythrocyte Production from Human Pluripotent Stem Cells," Stem Cell Reports, Dec. 17, 2013, vol. 1, No. 6, pp. 499-508, supplemental pp. 1-16.
Hoban et al., "Genetic treatment of a molecular disorder: gene therapy approaches to sickle cell disease," Blood, Feb. 18, 2016, vol. 127, No. 7, pp. 839-848.
Hogan et al., "Differential long-term and multilineage engraftment potential from subtractions of human CD34+ cord blood cells transplanted into NOD/SCID mice," Proceedings of the National Academy of Sciences of the United States of America, 2002, vol. 99, No. 1, pp. 413-418.

(56) References Cited

OTHER PUBLICATIONS

Hoggatt et al., "Rapid Mobilization Reveals a Highly Engraftable Hematopoietic Stem Cell," Cell, Jan. 11, 2018, vol. 172, pp. 1-14, e1-e7, supplemental pp. 1-3.
Hua et al.,. "Expanding the base editing scope in rice by using Cas9 variants," Plant Biotechnology Journal, 2019, vol. 17, No. 2, pp. 499-504.
Huang et al., "Circularly permuted and PAM-modified Cas9 variants broaden the targeting scope of base editors," Nature Biotechnology, Jun. 2019, vol. 37, No. 6, pp. 626-631.
Huang et al., "Comparative analysis of three-dimensional chromosomal architecture identifies a novel fetal hemoglobin regulatory element," Genes & Development, 2017, vol. 31, No. 16, pp. 1704-1713.
Huang et al., "Neutralizing negative epigenetic regulation by HDAC5 enhances human haematopoietic stem cell homing and engraftment," Nature Communications, 2018, vol. 9, Article No. 2741, pp. 1-13.
Husa et al., "Generation of CD34 Fluorescent Reporter Human Induced Pluripotent Stem Cells for Monitoring Hematopoietic Differentiation," Stem Cells and Development, 2018, vol. 27, No. 19, pp. 1376-1384.
Jin et al., "Cytosine, but not adenine, base editors induce genome-wide off-target mutations in rice," Science, 2019, vol. 364, No. 6437, pp. 292-295.
Jinek et al., "A Programmable Dual-RNA-Guided DNA Endonuclease in Adaptive Bacterial Immunity," Science, Aug. 17, 2012, vol. 337, No. 6096, pp. 816-821.
Jinek et al., "RNA-programmed genome editing in human cells," eLife, 2013, vol. 2, e00471, pp. 1-9.
Kariko et al., "Suppression of RNA recognition by Toll-like receptors: the impact of nucleoside modification and the evolutionary origin of RNA," Immunity, 2005, vol. 23, No. 2, pp. 165-175.
Karponi et al., "Plerixafor+G-CSF-mobilized CD34+ cells represent an optimal graft source for thalassemia gene therapy," Blood, Jul. 30, 2015, vol. 126, No. 5, pp. 616-619.
Karpova et al., "Continuous blockade of CXCR4 results in dramatic mobilization and expansion of hematopoietic stem and progenitor cells," Blood, May 25, 2017, vol. 129, No. 21, pp. 2939-2949.
Karpova et al., "Mobilization of hematopoietic stem cells with the novel CXCR4 antagonist POL6326 (balixafortide) in healthy volunteers—results of a dose escalation trial," Journal of Translational Medicine, 2017, vol. 15, No. 2, pp. 1-12.
Kim et al., "Genome-wide target specificity of CRISPR RNA-guided adenine base editors," Nature Biotechnology, 2019, vol. 37, No. 4, pp. 430-435.
Kim et al., "Increasing the genome-targeting scope and precision of base editing with engineered Cas9-cytidine deaminase fusions," Nature Biotechnology, Apr. 2017, vol. 35, No. 4, pp. 371-376.
Kim et al., "Rescue of high-specificity Cas9 variants using sgRNAs with matched 5' nucleotides," Genome Biology, 2017, vol. 18, Article No. 218, pp. 1-6.
Kim et al., "Structural and Kinetic Characterization of *Escherichia coli* TadA, the Wobble-Specific tRNA Deaminase," Biochemistry, Apr. 29, 2006, vol. 45, No. 20, pp. 6407-6416.
Kim et al., "Highly efficient RNA-guided base editing in mouse embryos," Nature Biotechnology, 2017, vol. 35, No. 5, pp. 435-437.
Kitko et al., "Preparing the Patient for HSCT: Conditioning Regimens and Their Scientific Rationale," Hematopoietic Stem Cell Transplantation for the Pediatric Hematologist/Oncologist, Sep. 4, 2017, pp. 139-174.
Kleinstiver et al., "Broadening *Staphylococcus aureus* Cas9 Targeting Range by Modifying PAM Recognition," Mature Biotechnology, Dec. 2015, vol. 33, No. 12, pp. 1293-1298.
Kleinstiver et al., "Engineered CRISPR-Cas9 nucleases with altered PAM specificities," Jul. 23, 2015, Nature, vol. 523, No. 7561, pp. 481-485.
Knapp et al., "Single-cell analysis identifies a CD33+ subset of human cord blood cells with high regenerative potential," Nature Cell Biology, Jun. 2018, vol. 20, No. 6, pp. 710-720.
Koblan et al., "Improving cytidine and adenine base editors by expression optimization and ancestral reconstruction," Mature Biotechnology, Oct. 2018, vol. 36, No. 9, pp. 843-846.
Komor et al., "Editing the Genome Without Double-Stranded DNA Breaks," ACS Chemical Biology, Feb. 16, 2018, vol. 13, No. 2, pp. 383-388.
Komor et al., "Improved base excision repair inhibition and bacteriophage Mu Gam protein yields C:G-to-T:A base editors with higher efficiency and product purity," Science Advances, Aug. 30, 2017, vol. 3, No. 8, eaao4774, pp. 1-9.
Komor et al., "Programmable editing of a target base in genomic DNA without double-stranded DNA cleavage," Nature, 2016, vol. 533, No. 7603, pp. 420-424.
Krokan et al., "Uracil in DNA—occurrence, consequences and repair," Oncogene, 2002, vol. 21, pp. 8935-8948.
Kuscu et al., "CRISPR-Cas9-AID base editor is a powerful gain-of-function screening tool," Nature Methods, Dec. 2016, vol. 13, No. 12, pp. 983-984.
Kuscu et al., "CRISPR-STOP: gene silencing through base-editing-induced nonsense mutations," Nature Methods, 2017, vol. 14, No. 7, pp. 710-712.
Kwart et al., "Precise and efficient scarless genome editing in stem cells using CORRECT," Nature Protocols, Feb. 2017, vol. 12, No. 2, pp. 329-354.
Kwon et al., "Anti-human CD117 antibody-mediated bone marrow niche clearance in nonhuman primates and humanized NSG mice," Blood, May 9, 2019, vol. 133, No. 19, pp. 2104-2108, supplemental pp. 1-16.
Lagresle-Peyrou et al., "Plerixafor enables the safe, rapid, efficient mobilization of haematopoietic stem cells in sickle cell disease patients after exchange transfusion," Haematologica, 2018, vol. 103, No. 5, p. 778-786, supplemental pp. 1-10.
Lau et al., "Molecular basis for discriminating between normal and damaged bases by the human alkyladenine glycosylase, AAG," Proceedings of the National Academy of Sciences of the United States of America, Dec. 5, 2000, vol. 97, No. 25, p. 13573-13578.
Lee et al., "CRISPR-Pass: Gene Rescue of Nonsense Mutations Using Adenine Base Editors," Molecular Therapy, Aug. 2019, vol. 27, No. 8, pp. 1364-1371.
Lee et al., "Cytosine base editor 4 but not adenine base editor generates off-target mutations in mouse embryos," Communications Biology, 2020, vol. 3, Article No. 19, pp. 1-6.
Lee et al., "Cytosine but not adenine base editor generates mutations in mice," bioRxiv, Aug. 12, 2019, pp. 1-24.
Leung et al., "Notch and AHR Signaling Impact Definitive Hematopoiesis from Human Pluripotent Stem Cells," Stem Dells, 2018, pp. 1-22.
Levasseur et al., "A Recombinant Human Hemoglobin with Anti-sickling Properties Greater than Fetal Hemoglobin," The Journal of Biological Chemistry, Jun. 25, 2004, vol. 279, No. 26, p. 27518-27524.
Levasseur et al., "Correction of a mouse model of sickle cell disease: lentiviral/antisickling β-globin gene transduction of unmobilized, purified hematopoietic stem cells," Blood, Dec. 15, 2003, vol. 102, No. 13, pp. 4312-4319.
Levi et al., "Treosulfan induces distinctive gonadal toxicity compared with busulfan," Oncotarget, 2018, vol. 9, No. 27, pp. 19317-19327.
Lewis et al., "Cytosine deamination and the precipitous decline of spontaneous mutation during Earth's history," Proceedings of the National Academy of Sciences of the United States of America, Jul. 19, 2016, vol. 113, No. 29, pp. 8194-8199.
Li et al., "Highly efficient and precise base editing in discarded human tripronuclear embryos," Protein & Cell, 2017, vol. 8, No. 10, pp. 776-779.
Li et al., "Isolation and transcriptome analyses of human erythroid progenitors: BFU-E and CFU-E," Blood, Dec. 4, 2014, vol. 124, No. 24, pp. 3636-3645.
Li et al., "Reactivation of γ-globin in adult β-YAC mice after ex vivo and in vivo hematopoietic stem cell genome editing," Blood, Jun. 28, 2018, vol. 131, No. 26, pp. 2915-2928.
Liang et al., "Correction of β-thalassemia mutant by base editor in human embryos," Protein & Cell, 2017, vol. 8, No. 11, pp. 811-822.

(56) References Cited

OTHER PUBLICATIONS

Lidonnici et al., "Plerixafor and G-CSF combination mobilizes hematopoietic stem and progenitors cells with a distinct transcriptional profile and a reduced in vivo homing capacity compared to plerixafor alone," Haematologica, 2017, vol. 102, No. 4, pp. e120-e124, supplemental appendix pp. 1-19.

Liu et al., "Direct Promoter Repression by BCL11A Controls the Fetal to Adult Hemoglobin Switch," Cell, Apr. 19, 2018, vol. 173, pp. 1-13, e1-e8, supplemental pp. 1-9.

Losey et al., "Crystal Structure of *Staphylococcus aureus* tRNA Adenosine Deaminase TadA in Complex with RNA," Nature Structural & Molecular Biology, Feb. 2006, vol. 13, No. 2, pp. 153-159.

Lu et al., "Precise Editing of a Target Base in the Rice Genome Using a Modified CRISPR/Cas9 System," Molecular Plant, Mar. 2017, vol. 10, No. 3, pp. 523-525.

Maas et al., "Identification and characterization of a human tRNA-specific adenosine deaminase related to the ADAR family of pre-mRNA editing enzymes," Proceedings of the National Academy of Sciences of the United States of America, Aug. 1999, vol. 96, No. 16, pp. 8895-8900.

MacBeth et al., "Inositol Hexakisphosphate Is Bound in the ADAR2 Core and Required for RNA Editing," Science, Sep. 2, 2005, vol. 309, No. 5740, pp. 1534-1539.

Martyn et al., "Natural regulatory mutations elevate the fetal globin gene via disruption of BCL11A or ZBTB7A binding," Nature Genetics, 2018, vol. 50, No. 4, pp. 498-503, supplemental pp. 1-20.

Masuda et al., "Transcription factors LRF and BCL11A independently repress expression of fetal hemoglobin," Science, Jan. 15, 2016, vol. 351, Iss. 6270, pp. 285-289.

Matthews et al., "Structures of human ADAR2 bound to dsRNA reveal base-flipping mechanism and basis for site selectivity," Nature Structural & Molecular Biology, May 2016, vol. 23, No. 5, pp. 426-433.

McDermott et al., "Comparison of human cord blood engraftment between immunocompromised mouse strains," Blood, 2010, vol. 116, No. 2, pp. 193-200.

McIntosh et al., "Nonirradiated NOD,B6.SCID Il2ry-/-Kit(W41/W41)(NBSGW) mice support multilineage engraftment of human hematopoietic cells," Stem Cell Reports, 2015, vol. 4, No. 2, pp. 171-180.

Medyouf, Hind, "The microenvironment in human myeloid malignancies: emerging concepts and therapeutic implications," Blood, 2017, vol. 129, No. 12, pp. 1617-1626.

Meng et al., "Substitutions in the β subunits of sickle-cell hemoglobin improve oxidative stability and increase the delay time of sickle-cell fiber formation," The Journal of Biological Chemistry, 2019, vol. 294, No. 11, pp. 4145-4159.

Mikami et al., "Comparison of CRISPR/Cas9 expression constructs for efficient targeted mutagenesis in rice," Plant Molecular Biology, 2015, vol. 88, No. 6, pp. 561-572.

Mohamad et al., "Human hemoglobin G-Makassar variant masquerading as sickle cell anemia," Hematology Reports, 2018, vol. 10, Article No. 7210, pp. 92-95.

Morrison et al., "A long noncoding RNA from the HBS1L-MYB intergenic region on chr6q23 regulates human fetal hemoglobin expression," Blood Cells, Molecules and Diseases, 2018, vol. 69, pp. 1-9.

Muller et al., "Nucleotide exchange and excision technology (NExT) DNA shuffling: A robust method for DNA fragmentation and directed evolution," Nucleic Acids Research, Aug. 1, 2005, vol. 33, No. 13, e117, pp. 1-9.

Musallam et al., "Fetal hemoglobin levels and morbidity in untransfused patients with β-thalassemia intermedia," Blood, Jan. 12, 2012, vol. 119, No. 2, pp. 364-367.

Myers et al., "Fine Structure Genetic Analysis of a β-Globin Promoter," Science, May 2, 1986, vol. 232, No. 4750, pp. 613-618.

Ngo et al., "Fetal haemoglobin levels and haematological characteristics of compound heterozygotes for haemoglobin S and deletional hereditary persistence of fetal haemoglobin," British Journal of Haematology, 2011, vol. 156, No. 2, pp. 259-264.

Niihara et al., "A Phase 3 trial of L-glutamine in sickle cell disease," The New England Journal of Medicine, 2018, vol. 379, No. 3, pp. 226-235.

Nishida et al., "Targeted nucleotide editing using hybrid prokaryotic and vertebrate adaptive immune systems," Science, Sep. 16, 2016, vol. 353, Iss. 6305, aaf8729.

Nishimasu et al., "Engineered CRISPR-Cas9 nuclease with expanded targeting space," Science, Sep. 21, 2018, vol. 361, Iss. 6408, pp. 1259-1262.

Notta et al., "Distinct routes of lineage development reshape the human blood hierarchy across ontogeny," Science, Jan. 3, 2016, vol. 351, Iss. 6269, aab2116.

Notta et al., "Engraftment of human hematopoietic stem cells is more efficient in female NOD/SCID/IL-2Rgc-null recipients," Blood, May 6, 2010, vol. 115, No. 18, pp. 3704-3707.

Notta et al., "Isolation of Single Human Hematopoietic Stem Cells Capable of Long-term Multilineage Engraftment," Science, Jul. 8, 2011, vol. 333, No. 6039, pp. 218-221, supplemental pp. 1-35.

Oakes et al., "CRISPR-Cas9 Circular Permutants as Programmable Scaffolds for Genome Modification," Cell, Jan. 10, 2019, vol. 176, Nos. 1 2, p. 254 267, e1-e6, supplemental pp. 1-10.

Pagnier et al., "Polymerization and solubility of recombinant hemoglobins α2β2 6 Glu—Ala (Hb Makassar) and α2β2 3 Glu—Ala, 23 Vallle," Comptes Rendus de l'Academie des Sciences, Serie III, Sciences de la vie, 1993, vol. 316, pp. 431-436.

Palchaudhuri et al., "Non-genotoxic conditioning for hematopoietic stem cell transplantation using a hematopoietic-cell-specific internalizing immunotoxin," Nature Biotechnology, Jul. 2016, vol. 34, No. 7, pp. 738-745, supplemental pp. 1-14.

Pang et al., "Anti-CD117 antibody depletes normal and myelodysplastic syndrome human hematopoietic stem cells in xengrafted mice," Blood, 2019, vol. 133, No. 19, pp. 2069-2078, supplemental pp. 1-24.

Panyasai et al., "Hemoglobin Variants in Northern Thailand: Prevalence, Heterogeneity and Molecular Characteristics," Genetic Testing and Molecular Biomarkers, 2016, vol. 20, No. 1, pp. 37-43.

Paquet et al., "Efficient introduction of specific homozygous and heterozygous mutations using CRISPR/Cas9," Nature, May 5, 2016, vol. 533, pp. 125-129.

Park et al., "A Comprehensive, Ethnically Diverse Library of Sickle Cell Disease-Specific Induced Pluripotent Stem Dells," Stem Cell Reports, Apr. 11, 2017, vol. 8, No. 4, pp. 1076-1085, supplemental pp. 1-3.

Park et al., "Digenome-seq web tool for profiling CRISPR specificity," Nature Methods, 2017, vol. 14, pp. 548-549.

Pattanayak et al., "High-throughput profiling of off-target DNA cleavage reveals RNA-programmed Cas9 nuclease specificity," Nature Biotechnology, Sep. 2013, vol. 31, No. 9, pp. 839-843.

Piel et al., "Sickle Cell Disease," The New England Journal of Medicine, 2017, vol. 376, No. 16, pp. 1561-1573.

Platt et al., "Mortality In Sickle Cell Disease: Life Expectancy and Risk Factors for Early Death," The New England Journal of Medicine, Jun. 9, 1994, vol. 330, No. 23, pp. 1639-1644.

Adachi et al., "Effects of β6 amino acid hydrophobicity on stability and solubility of hemoglobin tetramers," FEBS Letters, Jan. 2, 1993, vol. 315, No. 1, pp. 47-50.

Agliano et al., "Human acute leukemia cells injected in NOD/LtSz-scid/IL-2Rgamma null mice generate a faster and more efficient disease compared to other NOD/scid-related strains," International Journal of Cancer, 2008, vol. 123, No. 9, pp. 2222-2227.

Agrawal et al., "Hydroxyurea in Sickle Cell Disease: Drug Review," Indian Journal of Hematology and Blood Transfusion, 2014, vol. 30, No. 2, pp. 91-96.

Akinsheye et al., "Fetal hemoglobin in sickle cell anemia," Blood, 2011, vol. 118, No. 1, pp. 19-27.

Alexander et al., "HFE-associated hereditary hemochromatosis," Genetics in Medicine, May 2009, vol. 11, No. 5, pp. 307-313.

Ataga et al., "Crizanlizumab for the Prevention of Pain Crises in Sickle Cell Disease," The New England Journal of Medicine, Feb. 2, 2017, vol. 376, No. 5, pp. 429-439.

Badran et al., "Continuous evolution of Bacillus thuringiensis toxins overcomes insect resistance," Nature, May 5, 2016, vol. 533, No. 7601, pp. 58-63.

(56) References Cited

OTHER PUBLICATIONS

Baudin-Chich et al., "Enhanced Polymerization of Recombinant Human Deoxyhemoglobin β6 Glu-Ile," Proceedings of the National Academy of Sciences of the Untied States of America, Mar. 1990, vol. 87, No. 5, pp. 1845-1849.
Bergman et al., "A New β-Chain Variant Hb Stockholm [β 7(A4)Glu-Asp] Causes Falsely Low Hb A1c," Hemoglobin, 2009, vol. 33, No. 2, pp. 137-142.
Bernaudin et al., "Long-term results of related myeloablative stem-cell transplantation to cure sickle cell disease," Blood, 2007, vol. 110, No. 7, pp. 2749-2756.
Biasco et al., "In Vivo Tracking of Human Hematopoiesis Reveals Patterns of Clonal Dynamics during Early and Steady-State Reconstitution Phases," Cell Stem Cell, Jul. 7, 2016, vol. 19, No. 1, pp. 107-119, supplemental pp. 1-8.
Bihoreau et al., "Steric and hydrophobic determinants of the solubilities of recombinant sickle cell hemoglobins," Protein Science, Jan. 1992, vol. 1, No. 1, pp. 145-150.
Billon et al., "CRISPR-Mediated Base Editing Enables Efficient Disruption of Eukaryotic Genes through Induction of STOP Codons," Molecular Cell, Sep. 21, 2017, vol. 67, No. 6, pp. 1068-1079, e4.
Bird et al., "Expansion of Human and Murine Hematopoietic Stem and Progenitor Cells Ex Vivo without Genetic Modification Using MYC and Bcl-2 Fusion Proteins," PLoS One, Aug. 2014, vol. 9, Iss 8, e105525, pp. 1-20.
Blackwell et al., "Haemoglobin Siriraj, β-7 (βA4) Glu-Lys, in a Chinese Subject in Taiwan," Vox Sanguinis, 1972, vol. 23, pp. 433-438.
Blackwell et al., "Hemoglobin G Makassar: β-6 Glu leads to Ala," Biochimica et Biophysica Acta, 1970, vol. 214, No. 3, pp. 396-401.
Borsotti et al., "HSC extrinsic sex-related and intrinsic autoimmune disease-related human B-cell variation is recapitulated in humanized mice," Blood Advances, Oct. 24, 2017, vol. 1, No. 23, pp. 2007-2018.
Boulad et al., "Safety and efficacy of plerixafor dose escalation for the mobilization of CD34+ hematopoietic progenitorcells in patients with sickle cell disease: interim results," Haematologica, 2018, vol. 103, No. 5, p. 770-777, supplemental pp. 1-12.
Bradford et al., "Quiescence, cycling, and turnover in the primitive hematopoietic stem cell compartment," Experimental Hematology, 1997, vol. 25, No. 5, pp. 445-453.
Burroughs et al., "Allogeneic Hematopoietic Cell Transplantation Using Treosulfan-Based Conditioning for Treatment of Marrow Failure Disorders," Biology of Blood and Marrow Transplantation, 2017, vol. 23, No. 10, pp. 1669-1677.
Canver et al., "Customizing the genome as therapy for the β-hemoglobinopathies," Blood, May 26, 2016, vol. 127, No. 21, pp. 2536-2545.
Canver et al., "Integrated design, execution, and analysis of arrayed and pooled CRISPR genome-editing experiments," Nature Protocols, 2018, vol. 13, No. 5, pp. 946-986.
Chadwick et al., "In Vivo Base Editing of PCSK9 (Proprotein Convertase Subtilisin/Kexin Type 9) as a Therapeutic Alternative to Genome Editing," Arteriosclerosis, Thrombosis, and Vascular Biology, Sep. 2017, vol. 37, Iss. 9, pp. 1741-1747.
Chang et al., "Comparative Studies Reveal Robust HbF Induction By Editing of HBG1/2 Promoters or BCL11A Erythroid-Enhancer in Human CD34+ Cells but That BCL11A Erythroid-Enhancer Editing Is Associated with Selective Reduction in Erythroid Lineage Reconstitution in a Xenotransplantation Model," Blood, 2018, vol. 132, Supplement 1, p. 409.
Chang et al., "Long-Term Engraftment and Fetal Globin Induction upon BCL11A Gene Editing in Bone-Marrow-Derived CD34+ Hematopoietic Stem and Progenitor Cells," Molecular Therapy: Methods & Clinical Development, 2017, vol. 4, pp. 137-148 and supplemental pp. 1-7.
Chang et al., "Saturated Mutagenesis Surrounding Beta-globin Locus Identifies Novel Therapeutic Targets for Fetal Globin Induction and Treatment of Sickle Cell Anemia," Editas Medicine, PowerPoint Presentation, 2018, 1 page.

Chaudhari et al., "Evaluation of Homology-Independent CRISPR-Cas9 Off-Target Assessment Methods," The CRISPR Journal, 2020, vol. 3, No. 6, pp. 440-453.
Cheng et al., "Plerixafor is effective given either preemptively or as a rescue strategy in poor stem cell mobilizing patients with multiple myeloma," Transfusion, Feb. 2015, vol. 55, No. 2, pp. 275-283.
Chhabra et al., "Hematopoietic stem cell transplantation in immunocompetent hosts without radiation or chemotherapy," Science Translational Medicine, Aug. 10, 2016, vol. 8, Iss. 351, 351ra105, pp. 1-28.
Choi et al., "No evidence for cell activation or brain vaso-occlusion with plerixafor mobilization in sickle cell mice," Blood Cells, Molecules, and Diseases, Mar. 2016, vol. 57, pp. 67-70.
Cong et al., "Multiplex genome engineering using CRISPR/Cas systems," Science, Feb. 15, 2013, vol. 339, No. 6121, pp. 819-823, supplemental pp. 1-5.
Corrado et al., "SOD1 gene mutations in Italian patients with Sporadic Amyotrophic Lateral Sclerosis (ALS)," Neuromuscular Disorders, Sep. 6, 2006, vol. 16, No. 11, pp. 800-804.
Cyranoski, David, "Blood stem cells produced in vast quantities in the lab," Nature, Jun. 6, 2019, vol. 570, pp. 17-18.
Czechowicz et al., "Selective hematopoietic stem cell ablation using CD117-antibody-drug-conjugates enables safe and effective transplantation with immunity preservation," Nature Communications, 2019, vol. 10, Article No. 617, pp. 1-21.
Devi et al., "Neutrophil mobilization via plerixafor-mediated CXCR4 inhibition arises from lung demargination and blockade of neutrophil homing to the bone marrow," The Journal of Experimental Medicine, 2013, vol. 210, No. 11, pp. 2321-2336.
Dewitt et al., "Selection-free genome editing of the sickle mutation in human adult hematopoietic stem/progenitor cells," Science Translational Medicine, Oct. 12, 2016, vol. 8, Iss. 360, pp. 1-20.
Doulatov et al., "Revised map of the human progenitor hierarchy shows the origin of macrophages and dendritic cells in early lymphoid development," Nature Immunology, 2010, vol. 11, No. 7, pp. 585-593.
Du et al., "Biomarker signatures of sickle cell disease severity," Blood Cells, Molecules, and Diseases, Sep. 2018, vol. 72, pp. 1-9.
Eaton et al., "Treating sickle cell disease by targeting HbS polymerization," Blood, 2017, vol. 129, No. 20, pp. 2719-2726.
Edison et al., "A novel β globin gene mutation HBB.c.22 G>C produces a hemoglobin variant (Hb Vellore) mimicking HbS in HPLC," International Journal of Laboratory Hematology, 2012, vol. 34, No. 5, pp. 556-558.
Ema et al., "Repopulation dynamics of single haematopoietic stem cells in mouse transplantation experiments Importance of stem cell composition in competitor cells," Journal of Theoretical Biology, 2016, vol. 394, pp. 57-67.
Engelward et al., "Base excision repair deficient mice lacking the Aag alkyladenine DNA glycosylase," Proceedings of the National Academy of Sciences of the United States of America, Nov. 1997, vol. 94, No. 24, p. 13087-13092.
Esrick et al., "Successful hematopoietic stem cell mobilization and apheresis collection using plerixafor alone in sickle cell patients," Blood Advances, 2018, vol. 2, No. 19, pp. 2505-2512.
Esvelt et al., "A system for the continuous directed evolution of biomolecules," Nature, Apr. 28, 2011, vol. 472, No. 7344, pp. 499-503.
FDA, "FDA approves crizanlizumab-tmca for sickle cell disease," Food and Drug Administration (FDA), Nov. 15, 2019, https://www.fda.gov/drugs/resources-information-approved-drugs/fda-approves-crizanlizumab-tmca-sickle-cell-disease.
Fiorini et al., "Developmentally-faithful and effective human erythropoiesis in immunodeficient and Kit mutant mice," American Journal of Hematology, 2017, vol. 92, No. 9, pp. E513-E519.
Fitzhugh et al., "At least 20% donor myeloid chimerism is necessary to reverse the sickle phenotype after allogeneic HSCT," Blood, Oct. 26, 2017, vol. 130, No. 17, pp. 1946-1948.
Fitzhugh et al., "Granulocyte Colony-Stimulating Factor (G-CSF) Administration in Individuals with Sickle Cell Disease: Time for a Moratorium?" Cytotherapy, 2009, vol. 11, No. 4, pp. 464-471.

(56) References Cited

OTHER PUBLICATIONS

Forget B. G., "Molecular basis of hereditary persistence of fetal hemoglobin," Annals of the New York Academy of Sciences, 1998, vol. 850, pp. 38-44.
Fukui, Kenji, "DNA Mismatch Repair in Eukaryotes and Bacteria," Journal of Nucleic Acids, 2010, vol. 2010, Article ID 260512, pp. 1-16.

| PAM | L1111 | D1135 | S1136 | S1216 | G1218 | E1219 | A1322 | R1335 | T1337 |
|---|---|---|---|---|---|---|---|---|---|
| NGC |  | M | Q |  | K | S |  | E | R |
| NGA |  | V |  |  | R |  |  | Q | R |
| NGCG |  | V |  |  | R |  |  | E | R |
| NGN | R | V |  |  | R | F | R | A | R |
| NGC |  | G |  | G |  |  |  | Q |  |
|  |  |  |  |  |  | V |  |  |  |

| | |
|---|---|
| MSP616 | pMRNA-Trilink-ISLAY2-monoTadA-ABE7.10(V82S)-MQKFRAER 120A Bbsl |
| MSP617 | pMRNA-Trilink-ISLAY3-monoTadA-ABE7.10(V82S)-MQKFRAER 120A Bbsl |
| MSP684 | pMRNA-Trilink-ISLAY3-ABE7.10(V82S, Y147T, Q154S)-MQKFRAER 120A Bbsl |
| MSP686 | pMRNA-Trilink-ISLAY3-ABE7.10(V82T, Y147T, Q154S)-MQKFRAER 120A Bbsl |

21nt protospacer:
5'-gsascsUsCUCCACAGGAGUCAGG GUUUUAGAGC UAGAAAUAGC AAGUUAAAAU AAGGCUAGUC CGUUAUCAAC UUGAAAAAGU GGCACCGAGU CGGUGCUsUsUsU-3'

20nt protospacer:
5'-ascsUsCUCCACAGGAGUCAGG GUUUUAGAGC UAGAAAUAGC AAGUUAAAAU AAGGCUAGUC CGUUAUCAAC UUGAAAAAGU GGCACCGAGU CGGUGCUsUsUsU-3'

19nt protospacer:
5'-csUsUsCCACAGGAGUCAGG GUUUUAGAGC UAGAAAUAGC AAGUUAAAAU AAGGCUAGUC CGUUAUCAAC UUGAAAAAGU GGCACCGAGU CGGUGCUsUsUsU-3'

FIG. 42

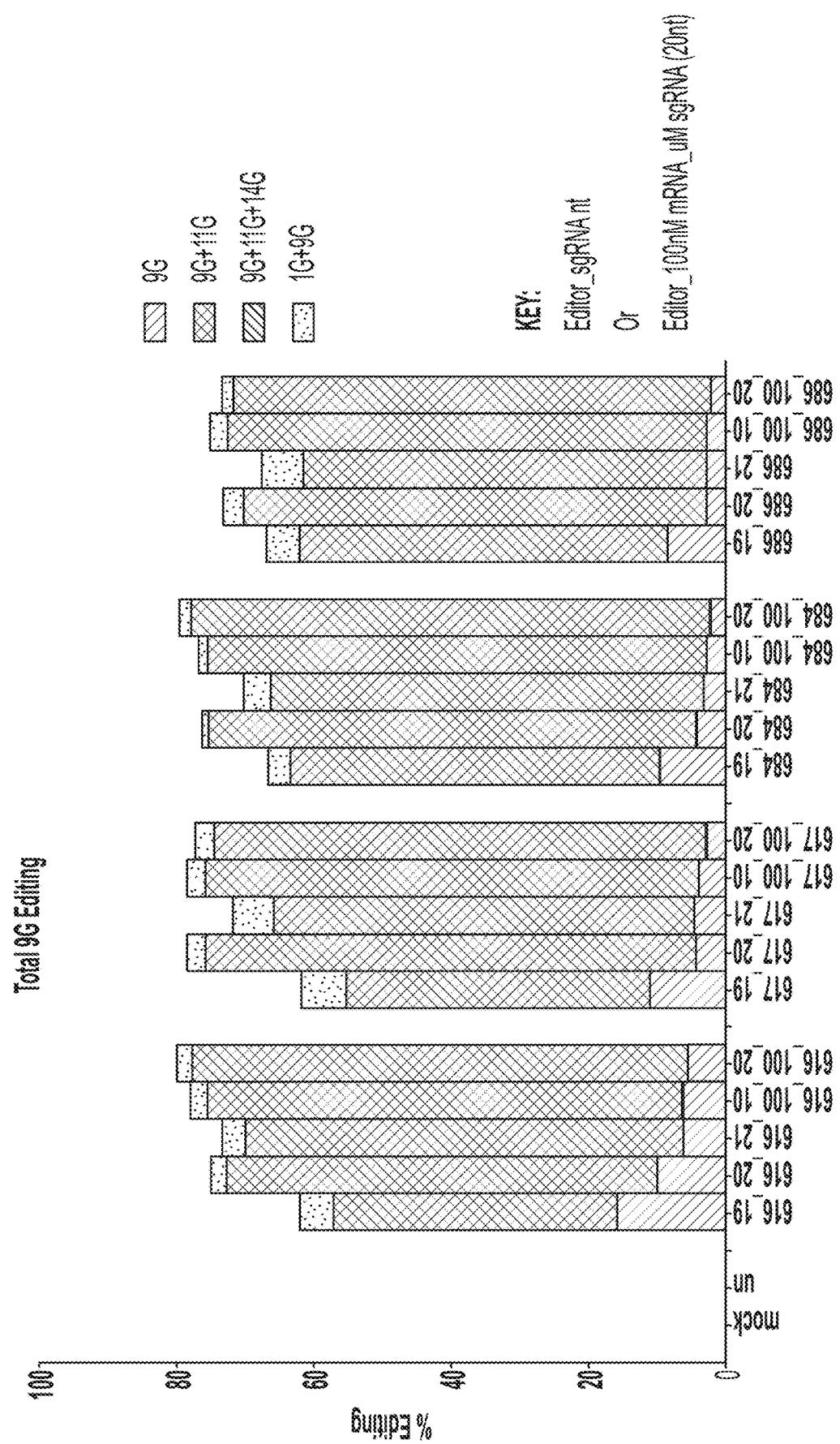

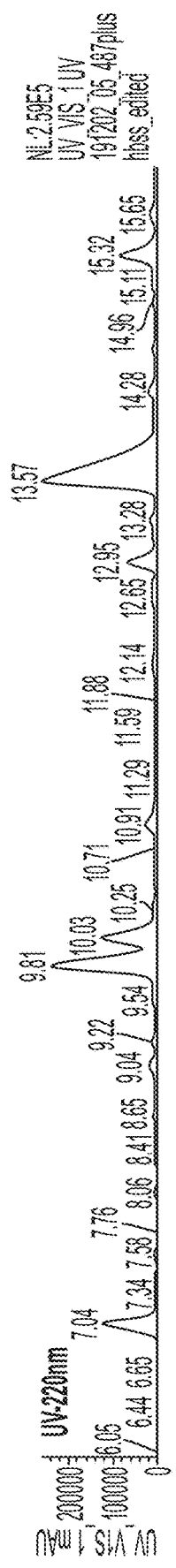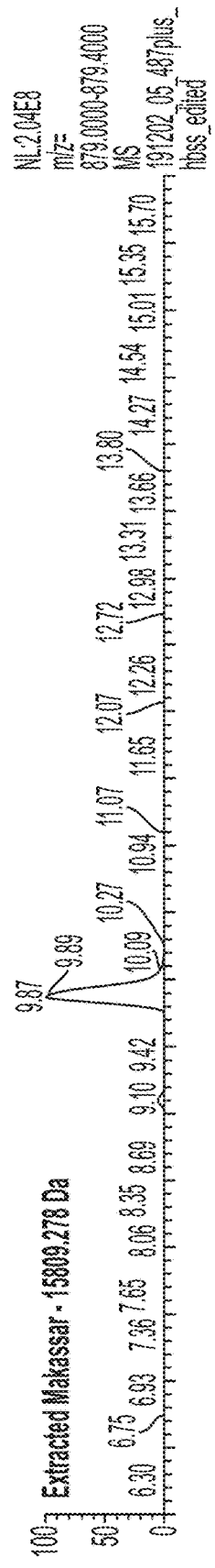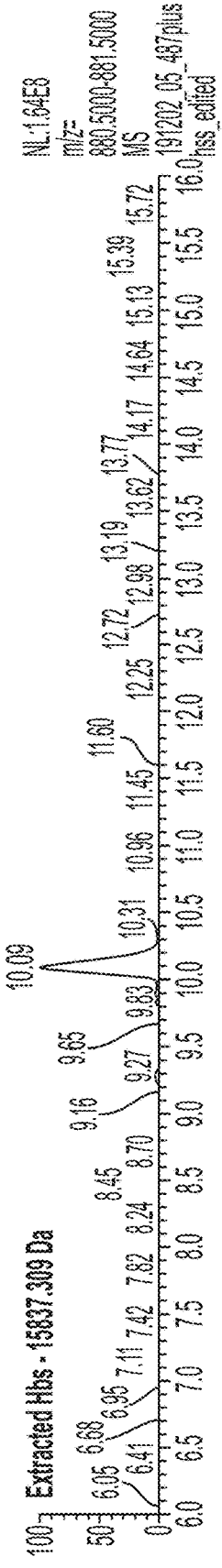
FIG. 46A

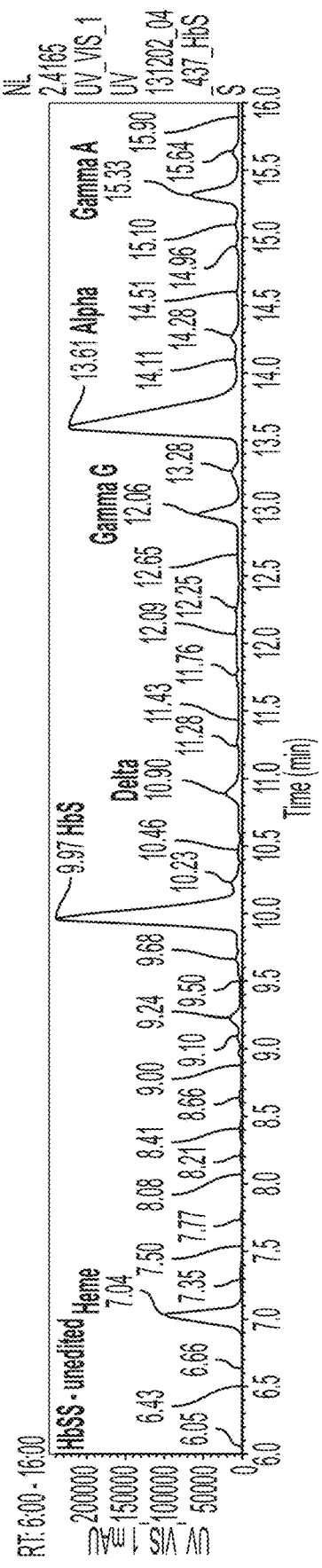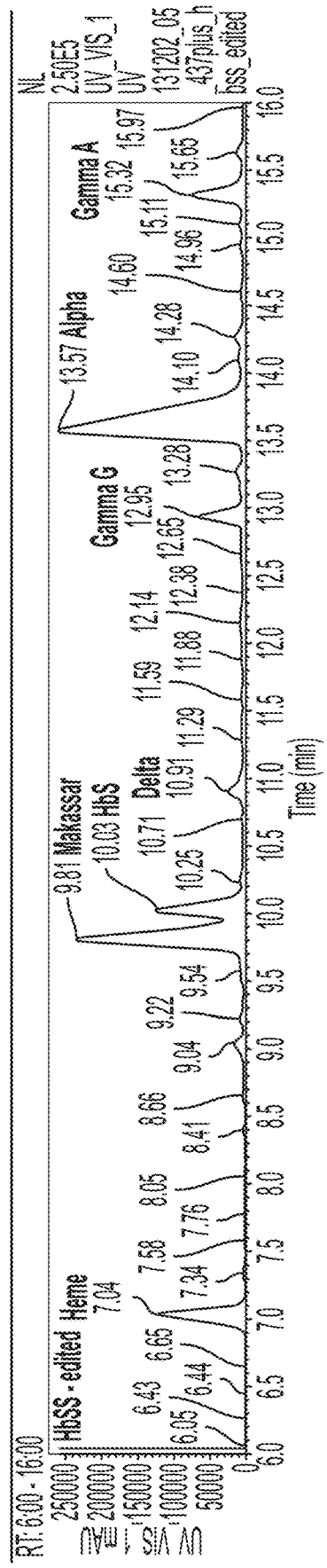
FIG. 47

FIG. 49

| PAM scope | NGGN | NGRN + NGCG | NGGN + NGCG | NNNRRT | NGNN | NGNN + NANG | NRRH + NGGN | NRTH + NGGN | NRCH + NGGN |
|---|---|---|---|---|---|---|---|---|---|
|  | SpCas9 | SpCas9-VQR/VRQR | SpCas9-VRER | SaCas9-KKH | xCas9 | SpCas9-NG | SpCas9-NRRH | SpCas9-NRTH | SpCas9-NRCH |
| NGGG | ● | ● | ● |  | ● | ● | ● | ● | ● |
| NGGT | ● | ● | ● | ● | ● | ● | ● | ● | ● |
| NGGC | ● | ● | ● |  | ● | ● | ● | ● | ● |
| NGGA | ● | ● | ● |  | ● | ● | ● | ● | ● |
| NGTG |  |  |  |  | ● | ● |  |  |  |
| NGTT |  |  |  |  | ● | ● | ● | ● |  |
| NGTC |  |  |  |  | ● | ● | ● | ● |  |
| NGTA |  |  |  |  | ● | ● | ● | ● |  |
| NGCG |  | ● | ● |  | ● | ● |  |  |  |
| NGCT |  |  |  |  | ● | ● |  |  | ● |
| NGCC |  |  |  |  | ● | ● |  |  | ● |
| NGCA |  |  |  |  | ● | ● |  |  | ● |
| NGAG |  | ● |  |  | ● | ● |  |  |  |
| NGAT |  | ● |  | ● | ● | ● | ● |  |  |
| NGAC |  | ● |  |  | ● | ● | ● |  |  |
| NGAA |  | ● |  |  | ● | ● | ● |  |  |
| NAGG |  |  |  |  |  | ● |  |  |  |
| NAGT |  |  |  | ● |  | ● | ● |  |  |
| NAGC |  |  |  |  |  | ● | ● |  |  |
| NAGA |  |  |  |  |  | ● | ● |  |  |
| NATG |  |  |  |  |  | ● |  |  |  |
| NATT |  |  |  |  |  |  |  | ● |  |
| NATC |  |  |  |  |  |  |  | ● |  |
| NATA |  |  |  |  |  |  |  | ● |  |
| NACG |  |  |  |  |  | ● |  |  |  |
| NACT |  |  |  |  |  |  |  |  | ● |
| NACC |  |  |  |  |  |  |  |  | ● |
| NACA |  |  |  |  |  |  |  |  | ● |
| NAAG |  |  |  |  |  | ● |  |  |  |
| NAAT |  |  |  | ● |  | ● |  |  |  |
| NAAC |  |  |  |  |  |  | ● |  |  |
| NAAA |  |  |  |  |  |  | ● |  |  |

COMPOSITIONS AND METHODS FOR TREATING HEMOGLOBINOPATHIES

CROSS REFERENCE TO RELATED APPLICATIONS

This application is a U.S. National Stage filed under 35 U.S.C. § 111(a), which is a continuation of and claims priority to International Application No. PCT/US2020/018193, filed on Feb. 13, 2020, which claims priority to and benefit of U.S. Provisional Application Nos. 62/805,271 filed Feb. 13, 2019; 62/805,277, filed Feb. 13, 2019; 62/852,224, filed May 23, 2019; 62/852,228, filed May 23, 2019; 62/931,722, filed Nov. 6, 2019; 62/931,747, filed Nov. 6, 2019; 62/941,569, filed Nov. 27, 2019; and 62/966,526, filed Jan. 27, 2020, the contents of all of which are incorporated by reference herein in their entireties.

SEQUENCE LISTING

The instant application contains a Sequence Listing which has been submitted electronically in ASCII format and is hereby incorporated by reference in its entirety. Said ASCII copy, created on Apr. 30, 2021, is named 180802.042104_US_SL.txt and is 838,729 bytes in size.

INCORPORATION BY REFERENCE

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

BACKGROUND OF THE INVENTION

Sickle cell disease (SCD) is a group of disorders that affects hemoglobin, the molecule in red blood cells that delivers oxygen to cells throughout the body. People with this disorder have atypical hemoglobin molecules, which can distort red blood cells into a sickle, or crescent, shape. The clinical manifestations of sickle cell disease (SCD) result from intermittent episodes of microvascular occlusion leading to tissue ischemia/reperfusion injury and chronic hemolysis. Vaso-occlusive events are associated with ischemia/reperfusion damage to tissues resulting in pain and acute or chronic injury affecting any organ system. The bones/marrow, spleen, liver, brain, lungs, kidneys, and joints are often affected.

SCD is a genetic disorder characterized by the presence of at least one hemoglobin S allele (HbS; p.Glu6Val in HBB) and a second HBB pathogenic variant resulting in abnormal hemoglobin polymerization. HbS/S (homozygous p.Glu6Val in HBB) accounts for 60%-70% of SCD in the United States. The life expectancy for men and women suffering from SCD is only 42 and 48 years, respectively. Current methods of treatment are focused on managing the symptoms of the disease. Methods for editing the genetic mutations that cause SCD and other hemoglobinopathies are urgently required.

SUMMARY

As described below, the present invention features compositions and methods for editing deleterious mutations associated with sickle cell disease (SCD). In particular embodiments, the invention provides for the correction of SCD mutations using a modified adenosine deaminase base editor termed "ABE8" having unprecedented levels (e.g., >60-70%) of efficiency.

In one aspect, the invention features a method of editing a beta globin polynucleotide comprising a single nucleotide polymorphism (SNP) associated with sickle cell disease, the method comprising contacting a beta globin polynucleotide with one or more guide RNAs and a fusion protein comprising a polynucleotide programmable DNA binding domain and at least one base editor domain that is an adenosine deaminase variant comprising an alteration at amino acid position 82 and/or 166 of
MSEVEFSHEYWMRHALTLAKRAR-
DEREVPVGAVLVLNNRVIGEGWNRAIGLHDP-
TAHAEIMALRQGGLVM  QNYRLIDATLYVT-
FEPCVMCAGAMIHSRIGRVVFGVRNAKTGAAGSLMDVL-
HYPGMNHRVEITEGILADE
CAALLCYFFRMPRQVFNAQKKAQSSTD (SEQ ID NO: 2), wherein the guide RNA targets the base editor to effect an alteration of the SNP associated with sickle cell disease.

In another aspect, the invention features a method of editing a beta globin (HBB) polynucleotide comprising a single nucleotide polymorphism (SNP) associated with sickle cell disease, the method comprising contacting a beta globin polynucleotide with one or more guide RNAs and a fusion protein comprising a polynucleotide programmable DNA binding domain comprising the following sequence:

```
                                          (SEQ ID NO: 3)
EIGKATAKYFFYSNIMNFFKTEITLANGEIRKRPLIETNGETGEIVWDK

GRDFATVRKVLSMPQVNIVKKTEVQTGGFSKESILPKRNSDKLIARKKD

WDPKKYGGFMQPTVAYSVLVVAKVEKGKSKKLKSVKELLGITIMERSSF

EKNPIDFLEAKGYKEVKKDLIIKLPKYSLFELENGRKRMLASAKFLQKG

NELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAP

RAFKYFDTTIARKEYRSTKEVLDATLIHQSITGLYETRIDLSQLGGDGG

SGGSGGSGGSGGSGGSGGMDKKYSIGLAIGTNSVGWAVITDEYKVPSKK

FEWLGNTDRHSIKKNLIGALLFDSGETAEATRLKRTARRRYTRRKNRIC

YLQEIFSNEMAKVDDSFFHRLEESFLVEEDKKHERHPIFGNIVDEVAYH

EKYPTIYHLRKKLVDSTDKADLRLIYLALAHMIKFRGHFLIEGDLNPDN

SDVDKLFIQLVQTYNQLFEENPINASGVDAKAILSARLSKSRRLENLIA

QLPGEKKNGLFGNLIALSLGLTPNFKSNFDLAEDAKLQLSKDTYDDDLD

NLLAQIGDQYADLFLAAKNLSDAILLSDILRVNTEITKAPLSASMIKRY

DEHHQDLTLLKALVRQQLPEKYKEIFFDQSIMGYAGYIDGGASQEEFYK

FIKPILEKMDGTEELLVKLNREDLLRKQRTFDNGSIPHQIHLGELHAIL

RRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDI

VLTLTLFEDREMIEERLKTYAHLFDDKVMKQLKRRRYTGWGRLSRKLIN
```

-continued
GIRDKQSGKTILDFLKSDGFANRNFMQLIHDDSLTFKEDIQKAQVSGQG

DSLHEHIANLAGSPAIKKGILQTVKVVDELVKVMGRHKPENIVIEMARE

NQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNR

GKSDNVPSEEVVKKMKNYWRQLLNAKLITQRKFDNLTKAERGGLSELDK

AGFIKRQLVETRQITKHVAQILDSRMNTKYDENDKLIREVKVITLKSKL

VSDFRKDFQFYKVREINNYHHAHDAYLNAVVGTALIKKYPKLESEFVYG

DYKVYDVRKMIAKSEQ<u>EGADKRTADGSEFESPKKKRKV*</u>, wherein the bold sequence indicates sequence derived from Cas9, the italics sequence denotes a linker sequence, and the underlined sequence denotes a bipartite nuclear localization sequence, and at least one base editor domain comprising an adenosine deaminase variant comprising an alteration at amino acid position 82 and/or 166 of MSEVEFSHEYWMRHALTLAKRAR-DEREVPVGAVLVLNNRVIGEGWNRAIGLHDP-TAHAEIMALRQGGLVM QNYRLIDATLYVT-FEPCVMCAGAMIHSRIGRVVFGVRNAKTGAAGSLMDVL-HYPGMNHRVEITEGILADE CAALLCYFFRMPRQVFNAQKKAQSSTD (SEQ ID NO: 2).

In another aspect, the invention features a base editing system comprising the fusion protein of any previous aspect or otherwise described herein and a guide RNA comprising a nucleic acid sequence selected from the following CUU-CUCCACAGGAGUCAGAU (SEQ ID NO: 4); ACUU-CUCCACAGGAGUCAGAU (SEQ ID NO: 5); and GAC-UUCUCCACAGGAGUCAGAU (SEQ ID NO: 6). In one embodiment, the gRNA further contains a nucleic acid sequence GUUUUUGUACUCUCAAGAUUUA-AGUAACUGUACAACGAAACUUACACAGUUAC-UUAAAUCUUGCAGAAGC UACAAAGAUAAGGC-UUCAUGCCGAAAUCAACACCCUGUCAUUUUAU-GGCAGGGUG (SEQ ID NO: 7).
In another embodiment, the gRNA contains a nucleic acid sequence selected from CUUCUCCACAGGAGUCAGAU-GUUUUUGUACUCUCAAGAUUUAAGUAACUGUA-CAACGAAACUUACACAGU UACUUAAAUC-UUGCAGAAGCUACAAAGAUAAGGCUUCAUGCC-GAAAUCAACACCCUGUCAUUUUAUGGCA GGGUG (SEQ ID NO: 8);
ACUUCUCCACAGGAGUCAGAUGUUUUUGUACU-CUCAAGAUUUAAGUAACUGUACAACGAAACUUA-CACAG UUACUUAAAUCUUGCAGAAGCUA-CAAAGAUAAGGCUUCAUGCCGAAAUCAACACCCU-GUCAUUUUAUGGC AGGGUG (SEQ ID NO: 9); and
GACUUCUCCACAGGAGUCAGAUGUUUUUGUACU-CUCAAGAUUUAAGUAACUGUACAACGAAACUUA-CACA GUUACUUAAAUCUUGCAGAAGCUA-CAAAGAUAAGGCUUCAUGCCGAAAUCAACACCCU-GUCAUUUUAUGG CAGGGUG (SEQ ID NO: 10).

In another aspect, the invention features a cell produced by introducing into the cell, or a progenitor thereof: a base editor, a polynucleotide encoding the base editor, to the cell, wherein the base editor comprises a polynucleotide programmable DNA binding domain and an adenosine deaminase domain described in any aspect described herein; and one or more guide polynucleotides that target the base editor to effect an A•T to G•C alteration of the SNP associated with sickle cell disease. In one embodiment, the cell produced is a hematopoietic stem cell, a common myeloid progenitor, proerythroblast, erythroblast, reticulocyte, or erythrocyte. In another embodiment, the cell or progenitor thereof is a hematopoietic stem cell, a common myeloid progenitor, proerythroblast, or erythroblast. In another embodiment, the hematopoietic stem cell is a CD34+ cell. In another embodiment, the cell is from a subject having sickle cell disease. In another embodiment, the cell is a mammalian cell or human cell.

In another aspect, the invention features a method of treating sickle cell disease in a subject comprising administering to the subject a cell of any previous aspect or any other aspect of the invention delineated herein. In one embodiment, the cell is autologous to the subject. In another embodiment, the cell is allogenic to the subject.

In another aspect, the invention provides an isolated cell or population of cells propagated or expanded from the cell of any previous aspect or any other aspect of the invention delineated herein.

In another aspect, the invention provides a method of producing a red blood cell, or progenitor thereof, involving introducing into a red blood cell progenitor comprising an SNP associated with sickle cell disease, a base editor, or a polynucleotide encoding the base editor, wherein the base editor comprises a polynucleotide-programmable nucleotide-binding domain and an adenosine deaminase variant domain described in any previous aspect; and one or more guide polynucleotides, wherein the one or more guide polynucleotides target the base editor to effect an A•T to G•C alteration of the SNP associated with sickle cell disease; and differentiating the red blood cell progenitor into an erythrocyte. In one embodiment, the method involves differentiating the red blood cell progenitor into one or more of a hematopoietic stem cell, a common myeloid progenitor, proerythroblast, erythroblast, reticulocyte, or erythrocyte. In one embodiment, the method involves the red blood cell progenitor is a CD34+ cell. In another embodiment, the red blood cell progenitor is obtained from a subject having sickle cell disease. In another embodiment, the red blood cell progenitor is a mammalian cell or human cell. In another embodiment, the A•T to G•C alteration at the SNP associated with sickle cell disease changes a valine to an alanine in the HBB polypeptide. In another embodiment, the SNP associated with sickle cell disease results in expression of an HBB polypeptide having a valine at amino acid position 6. In another embodiment, the SNP associated with sickle cell disease substitutes a glutamic acid with a valine. In another embodiment, the cell is selected for the A•T to G•C alteration of the SNP associated with sickle cell disease. In another embodiment, the polynucleotide programmable DNA binding domain comprises a modified *Staphylococcus aureus* Cas9 (SaCas9), *Streptococcus thermophilus* 1 Cas9 (St1Cas9), a modified *Streptococcus pyogenes* Cas9 (SpCas9), or variants thereof.

In various embodiments of any of the above aspects or any other aspect of the invention described herein, the adenosine deaminase variant comprises alterations at amino acid position 82 and 166. In various embodiments of any of the above aspects or any other aspect of the invention described herein, the adenosine deaminase variant comprises a V82S alteration. In various embodiments of any of the above aspects or any other aspect of the invention described herein, the adenosine deaminase variant comprises a T166R alteration. In various embodiments of any of the above aspects or any other aspect of the invention described herein, the adenosine deaminase variant comprises V82S and T166R alterations. In various embodiments of any of the above aspects or any other aspect of the invention described herein, the adenosine deaminase variant further comprises one or more of the following alterations: Y147T, Y147R, Q154S, Y123H, and Q154R. In various embodiments of any of the above aspects or any other aspect of the invention described herein, the adenosine deaminase variant comprises a combination of alterations selected from the following: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; or I76Y+V82S+Y123H+Y147R+Q154R. In an embodiment of the above-delineated aspects, the adenosine deaminase variant comprises Y147R+Q154R+Y123H. In an embodiment of the above-delineated aspects, the adenosine deaminase variant comprises Y147R+Q154R+I76Y. In an embodiment of the above-delineated aspects, the adenosine deaminase variant comprises Y147R+Q154R+T166R. In an embodiment of the above-delineated aspects, the adenosine deaminase variant comprises Y147T+Q154R. In an embodiment of the above-delineated aspects, the adenosine deaminase variant comprises Y147T+Q154S. In an embodiment of the above-delineated aspects, the adenosine deaminase variant comprises Y147R+Q154S. In an embodiment of the above-delineated aspects, the adenosine deaminase variant comprises V82S+Q154S. In an embodiment of the above-delineated aspects, the adenosine deaminase variant comprises V82S+Y147R. In an embodiment of the above-delineated aspects, the adenosine deaminase variant comprises V82S+Q154R. In an embodiment of the above-delineated aspects, the adenosine deaminase variant comprises V82S+Y123H. In an embodiment of the above-delineated aspects, the adenosine deaminase variant comprises I76Y+V82S. In an embodiment of the above-delineated aspects, the adenosine deaminase variant comprises V82S+Y123H+Y147T. In an embodiment of the above-delineated aspects, the adenosine deaminase variant comprises V82S+Y123H+Y147R. In an embodiment of the above-delineated aspects, the adenosine deaminase variant comprises V82S+Y123H+Q154R. In an embodiment of the above-delineated aspects, the adenosine deaminase variant comprises Y123H+Y147R+Q154R+I76Y. In an embodiment of the above-delineated aspects, the adenosine deaminase variant comprises V82S+Y123H+Y147R+Q154R. In an embodiment of the above-delineated aspects, the adenosine deaminase variant comprises I76Y+V82S+Y123H+Y147R+Q154R. In other embodiments of the above aspects, the adenosine deaminase variant comprises a deletion of the C terminus beginning at a residue selected from the group consisting of 149, 150, 151, 152, 153, 154, 155, 156, and 157.

In various embodiments of any of the above aspects or any other aspect of the invention described herein, the cell is in vivo or ex vivo. In various embodiments of any of the above aspects or any other aspect of the invention described herein, the A•T to G•C alteration at the SNP associated with sickle cell disease changes a valine to an alanine in the HBB polypeptide. In various embodiments of any of the above aspects or any other aspect of the invention described herein, the SNP associated with sickle cell disease results in expression of an HBB polypeptide having a valine at amino acid position 6. In various embodiments of any of the above aspects or any other aspect of the invention described herein, the SNP associated with sickle cell disease substitutes a glutamic acid with a valine. In various embodiments of any of the above aspects or any other aspect of the invention described herein, the A•T to G•C alteration at the SNP associated with sickle cell disease results in expression of an HBB polypeptide having an alanine at amino acid position 6. In various embodiments of any of the above aspects or any other aspect of the invention described herein, the A•T to G•C alteration at the SNP associated with sickle cell disease substitutes a glutamic acid with an alanine.

In various embodiments of any of the above aspects or any other aspect of the invention described herein, the polynucleotide programmable DNA binding domain is a modified *Staphylococcus aureus* Cas9 (SaCas9), *Streptococcus thermophilus* 1 Cas9 (St1Cas9), a modified *Streptococcus pyogenes* Cas9 (SpCas9), or variants thereof. In various embodiments of any of the above aspects or any other aspect of the invention described herein, the polynucleotide programmable DNA binding domain comprises a variant of SpCas9 having an altered protospacer-adjacent motif (PAM) specificity or specificity for a non-G PAM. In various embodiments of any of the above aspects or any other aspect of the invention described herein, the altered PAM has specificity for the nucleic acid sequence 5'-NGC-3'. In various embodiments of any of the above aspects or any other aspect of the invention described herein, the modified SpCas9 comprises amino acid substitutions D1135M, S1136Q, G1218K, E1219F, A1322R, D1332A, R1335E, and T1337R, or corresponding amino acid substitutions thereof. In various embodiments of any of the above aspects or any other aspect of the invention described herein, the polynucleotide programmable DNA binding domain is a nuclease inactive or nickase variant. In various embodiments of any of the above aspects or any other aspect of the invention described herein, the nickase variant comprises an amino acid substitution D10A or a corresponding amino acid substitution thereof. In various embodiments of any of the above aspects or any other aspect of the invention described herein, the base editor further comprises a zinc finger domain. In various embodiments of any of the above aspects or any other aspect of the invention described herein, the zinc finger domain comprises recognition helix sequences RNEHLEV (SEQ ID NO: 11), QSTTLKR (SEQ ID NO: 12), and RTEHLAR (SEQ ID NO: 13) or recognition helix sequences RGEHLRQ (SEQ ID NO: 14), QSGTLKR (SEQ ID NO: 15), and RNDKLVP (SEQ ID NO: 16). In various embodiments of any of the above aspects or any other aspect of the invention described herein, the zinc finger domain is one or more of zflra or zflrb. In various embodiments of any of the above aspects or any other aspect of the invention described herein, the adenosine deaminase domain is capable of deaminating adenine in deoxyribonucleic acid (DNA). In various embodiments of any of the above aspects or any other aspect of the invention described herein, the one or more guide RNAs comprises a CRISPR RNA (crRNA) and a trans-encoded small RNA (tracrRNA), wherein the crRNA comprises a nucleic acid sequence complementary to an HBB nucleic acid sequence comprising the SNP associated with sickle cell disease. In various embodiments of any of the above aspects or any other aspect of the invention described herein, the base editor is in complex with a single guide RNA (sgRNA) comprising a nucleic acid sequence complementary to an HBB nucleic acid sequence comprising the SNP associated with sickle cell disease. In various embodiments of any of the above aspects or any other aspect of the invention described herein, the A•T to G•C alteration at the SNP associated with sickle cell disease changes a valine to an alanine in the HBB polypeptide. In another embodiment, the SNP associated with sickle cell disease results in expression of an HBB polypeptide having a valine at amino acid position 6. In another embodiment, the SNP associated with sickle cell disease substitutes a glutamic acid with a valine. In another embodiment, the A•T to G•C alteration at the SNP associated with sickle cell disease results in expression of an HBB polypeptide having an alanine at amino acid position 6. In another embodiment, the A•T to G•C alteration at the SNP associated with sickle cell disease substitutes a glutamic acid with an alanine. In another embodiment, the cell is selected for the A•T to G•C alteration of the SNP associated with sickle cell disease. In another embodiment, the polynucleotide programmable DNA binding domain is a modified *Staphylococcus aureus* Cas9 (SaCas9), *Streptococcus thermophilus* 1 Cas9 (St1Cas9), a modified *Streptococcus pyogenes* Cas9 (SpCas9), or variants thereof.

In an aspect, a method for treating sickle cell disease (SCD) in a subject is provided, in which the method comprises administering to the subject a fusion protein comprising an adenosine deaminase variant inserted within a Cas9 or a Cas12 polypeptide, or a polynucleotide encoding the fusion protein thereof; and one or more guide polynucleotides to target the fusion protein to effect an A•T to G•C alteration of a single nucleotide polymorphism (SNP) associated with SCD, thereby treating SCD in the subject.

In another aspect, a method of treating sickle cell disease (SCD) in a subject is provided, in which the method comprises administering to the subject an adenosine base editor 8 (ABE8), or a polynucleotide encoding said base editor, wherein the ABE8 comprises an adenosine deaminase variant inserted within a Cas9 or Cas12 polypeptide; and one or more guide polynucleotides that target the ABE8 to effect an A•T to G•C alteration of a SNP associated with SCD, thereby treating SCD in the subject.

In an embodiment of the above-delineated methods, the ABE8 is selected from ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m, ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d. In an embodiment of the above-delineated methods, the adenosine deaminase variant comprises the amino acid sequence of:
MSEVEFSHEYWMRHALTLAKRAR-DEREVPVGAVLVLNNRVIGEGWNRAIGLHDPTAH AEIMALRQGGLVMQNYRLIDATLYVTFEPCVMCAG-AMIHSRIGRVVFGVRNAKTGAA GSLMDVLHY-PGMNHRVEITEGILADECAALLCYFFRM-PRQVFNAQKKAQSSTD (SEQ ID NO: 2) and wherein the amino acid sequence comprises at least one alteration. In an embodiment, the adenosine deaminase variant comprises alterations at amino acid position 82 and/or 166. In an embodiment, the at least one alteration comprises: V82S, T166R, Y147T, Y147R, Q154S, Y123H, and/or Q154R.

In an embodiment of the above-delineated methods, the adenosine deaminase variant comprises one of the following combination of alterations: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+ Y123H+Y147R+Q154R; and I76Y+V82S+Y123H+ Y147R+Q154R. In an embodiment of the above-delineated methods, the adenosine deaminase variant is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, or TadA*8.24. In an embodiment, the adenosine deaminase variant comprises a deletion of the C terminus beginning at a residue selected from the group consisting of 149, 150, 151, 152, 153, 154, 155, 156, and 157. In an embodiment, the adenosine deaminase variant is an adenosine deaminase monomer comprising a TadA*8 adenosine deaminase variant domain. In an embodiment, the adenosine deaminase variant is an adenosine deaminase heterodimer comprising a wild-type adenosine deaminase domain and a TadA*8 adenosine deaminase variant domain. In an embodiment, the adenosine deaminase variant is an adenosine deaminase heterodimer comprising a TadA domain and a TadA*8 adenosine deaminase variant domain.

In an embodiment of the above-delineated methods, the SNP associated with SCD is located in the beta globin (HBB) gene. In an embodiment of the above-delineated methods, the SNP results in expression of an HBB polypeptide having a valine at amino acid position 6. In an embodiment of the above-delineated methods, the SNP substitutes a glutamic acid with a valine. In an embodiment of the above-delineated methods, the A•T to G•C alteration at the SNP changes a valine to an alanine in the HBB polypeptide. In an embodiment of the above-delineated methods, the A•T to G•C alteration at the SNP results in expression of an HBB polypeptide having an alanine at amino acid position 6. In an embodiment of the above-delineated methods, the A•T to G•C alteration at the SNP substitutes a glutamic acid with an alanine.

In an embodiment of the above-delineated methods, the adenosine deaminase variant is inserted within a flexible loop, an alpha helix region, an unstructured portion, or a solvent accessible portion of the Cas9 or Cas12 polypeptide. In an embodiment of the above-delineated methods, the adenosine deaminase variant is flanked by a N-terminal fragment and a C-terminal fragment of the Cas9 or Cas12 polypeptide. In an embodiment of the above-delineated methods, the fusion protein or ABE8 comprises the structure NH$_2$-[N-terminal fragment of the Cas9 or Cas12 polypeptide]-[adenosine deaminase variant]-[C-terminal fragment of the Cas9 or Cas12 polypeptide]-COOH, wherein each instance of "14" is an optional linker. In an embodiment, the C-terminus of the N terminal fragment or the N-terminus of the C terminal fragment comprises a part of a flexible loop of the Cas9 or the Cas12 polypeptide. In an embodiment, the flexible loop comprises an amino acid in proximity to the target nucleobase when the adenosine deaminase variant deaminates the target nucleobase.

In an embodiment of the above-delineated methods, the methods further comprise administering to the subject a guide nucleic acid sequence to effect deamination of the SNP target nucleobase associated with SCD. In an embodiment, the deamination of the SNP target nucleobase replaces the target nucleobase with a non-wild type nucleobase, and wherein the deamination of the target nucleobase ameliorates symptoms of sickle cell disease. In an embodiment, the deamination of the SNP associated with sickle cell disease substitutes a glutamic acid with an alanine.

In an embodiment of the above-delineated methods, the target nucleobase is 1-20 nucleobases away from a PAM sequence in the target polynucleotide sequence. In an embodiment, the target nucleobase is 2-12 nucleobases upstream of the PAM sequence. In an embodiment of the above-delineated methods, the N-terminal fragment or the C-terminal fragment of the Cas9 or Cas12 polypeptide binds the target polynucleotide sequence. In certain embodiments, the N-terminal fragment or the C-terminal fragment comprises a RuvC domain; the N-terminal fragment or the C-terminal fragment comprises a HNH domain; neither of the N-terminal fragment and the C-terminal fragment comprises an HNH domain; or neither of the N-terminal fragment and the C-terminal fragment comprises a RuvC domain. In an embodiment, the Cas9 or Cas12 polypeptide comprises a partial or complete deletion in one or more structural domains and wherein the deaminase is inserted at the partial or complete deletion position of the Cas9 or Cas12 polypeptide. In certain embodiments, the deletion is within a RuvC domain; the deletion is within an HNH domain; or the deletion bridges a RuvC domain and a C-terminal domain.

In an embodiment of the above-delineated methods, the fusion protein or ABE8 comprises a Cas9 polypeptide. In an embodiment, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or variants thereof. In an embodiment, the Cas9 polypeptide comprises the following amino acid sequence (Cas9 reference sequence):

(SEQ ID NO: 1)
MDKK<u>YSIGLDIGTNSVGWAVITDEYKVPSKKFKVLGNTDRHSIKKNLIG</u>

<u>ALLFDSGET</u>AEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTFDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQG<u>DSLHEHIANLAGSPAIKK</u>

<u>GILQTVKVVDELVKVMGRHKPENIVIEMAR</u>ENQTTQKG<u>QKNSRERMKRI</u>

<u>EEGIKELGSQILKEHPVENTQLQNEKLYLYYLQNGRDMYVDQELDINRL</u>

<u>SDYDVDHIVPQSFLKDDSIDNKVLTRSDKNRGKSDNVPSEEVVKKMKNY</u>

<u>WRQLLNAKLITQRKFDNLTKAERGGLSELDKAGFIKRQLVETRQITKHV</u>

<u>AQILDSRMNTKYDENDKLIREVKVITLKSKLVSDFRKDFQFYKVREINN</u>

<u>YHHAHDAYLNAVVGTALIKKYPKLESEFVYGDYKVYDVRKMIAKSEQEI</u>

<u>GKATAKYFFYSNIMNFFKTEITLANGEIRKRPLIETNGETGEIVWDKGR</u>

<u>DFATVRKVLSMPQV</u>=<u>NIVKKTEVQT</u>GGFSKESILPKRNSDKLIARKKDWD

PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD (single underline: HNH domain; double underline: RuvC domain; (Cas9 reference sequence), or a corresponding region thereof. In certain embodiments, the Cas9 polypeptide comprises a deletion of amino acids 1017-1069 as numbered in the Cas9 polypeptide reference sequence or corresponding amino acids thereof the Cas9 polypeptide comprises a deletion of amino acids 792-872 as numbered in the Cas9 polypeptide reference sequence or corresponding amino acids thereof; or the Cas9 polypeptide comprises a deletion of amino acids 792-906 as numbered in the Cas9 polypeptide reference sequence or corresponding amino acids thereof.

In an embodiment of the above-delineated methods, the adenosine deaminase variant is inserted within a flexible loop of the Cas9 polypeptide. In an embodiment, the flexible loop comprises a region selected from the group consisting of amino acid residues at positions 530-537, 569-579, 686-691, 768-793, 943-947, 1002-1040, 1052-1077, 1232-1248, and 1298-1300 as numbered in the Cas9 reference sequence, or corresponding amino acid positions thereof.

In an embodiment of the above-delineated methods, the deaminase variant is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the Cas9 reference sequence, or corresponding amino acid positions thereof. In an embodiment of the above-delineated methods, the deaminase variant is inserted between amino acid positions 768-769, 792-793, 1022-1023, 1026-1027, 1040-1041, 1068-1069, or 1247-1248 as numbered in the Cas9 reference sequence or corresponding amino acid positions thereof. In an embodiment of the above-delineated methods, the deaminase variant is inserted between amino acid positions 1016-1017, 1023-1024, 1029-1030, 1040-1041, 1069-1070, or 1247-1248 as numbered in the Cas9 reference sequence or corresponding amino acid positions thereof. In an embodiment of the above-delineated methods, the adenosine deaminase variant is inserted within the Cas9 polypeptide at the loci identified in Table 14A. In an embodiment, the N-terminal fragment comprises amino acid residues 1-529, 538-568, 580-685, 692-942, 948-1001, 1026-1051, 1078-1231, and/or 1248-1297 of the Cas9 reference sequence, or corresponding residues thereof. In an embodiment, the C-terminal fragment comprises amino acid residues 1301-1368, 1248-1297, 1078-1231, 1026-1051, 948-1001, 692-942, 580-685, and/or 538-568 of the Cas9 reference sequence, or corresponding residues thereof.

In an embodiment of the above-delineated methods, the Cas9 polypeptide is a modified Cas9 and has specificity for an altered PAM or a non-G PAM. In an embodiment of the above-delineated methods, the Cas9 polypeptide is a nickase or wherein the Cas9 polypeptide is nuclease inactive. In an embodiment of the above-delineated methods, the Cas9 polypeptide is a modified SpCas9 polypeptide. In an embodiment, the modified SpCas9 polypeptide, which includes amino acid substitutions D1135M, S1136Q, G1218K, E1219F, A1322R, D1332A, R1335E, and T1337R (SpCas9-MQKFRAER) and which has specificity for the altered PAM 5'-NGC-3'.

In another embodiment of the above-delineated methods, the fusion protein or ABE8 comprises a Cas12 polypeptide. In an embodiment, the adenosine deaminase variant is inserted into the Cas12 polypeptide. In an embodiment, the Cas12 polypeptide is Cas12a, Cas12b, Cas12c, Cas12d, Cas12e, Cas12g, Cas12h, or Cas12i. In an embodiment, the adenosine deaminase variant is inserted between amino acid positions: a) 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, or Cas12i; b) 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, or Cas12i; or c) 157 and 158, 258 and 259, 310 and 311, 1008 and 1009, or 1044 and 1045 of AaCas12b, or a corresponding amino acid residue of Cas12a, Cas12c, Cas12d, Cas12e, Cas12g, Cas12h, or Cas12i. In an embodiment, the adenosine deaminase variant is inserted within the Cas12 polypeptide at the loci identified in Table 14B. In an embodiment, the Cas12 polypeptide is Cas12b. In an embodiment, the Cas12 polypeptide comprises a BhCas12b domain, a BvCas12b domain, or an AACas12b domain.

In an embodiment of the above-delineated methods, the guide RNA comprises a CRISPR RNA (crRNA) and a trans-activating crRNA (tracrRNA). In an embodiment of the above-delineated methods, the subject is a mammal or a human.

In another aspect, a pharmaceutical composition comprising a base editing system comprising the fusion protein of any one of the above-delineated methods, aspects and embodiments, and a pharmaceutically acceptable carrier, vehicle, or excipient is provided. In an embodiment, the pharmaceutical composition further comprises a guide RNA comprising a nucleic acid sequence selected from the group consisting of CUUCUCCACAGGAGUCAGAU (SEQ ID NO: 4); ACUUCUCCACAGGAGUCAGAU (SEQ ID NO: 5); and GACUUCUCCACAGGAGUCAGAU (SEQ ID NO: 6). In an embodiment, the gRNA further comprises a nucleic acid sequence GUUUUUGUACUCUCAAGAUUUAAGUAACUGUA-CAACGAAACUUACACAGUUACU UAAAUC-UUGCAGAAGCUACAAAGAUAAGGCUU-CAUGCCGAAAUCAACACCCUGU CAUUUUAUGGCAGGGUG (SEQ ID NO: 7). In an embodiment, the gRNA comprises a nucleic acid sequence selected from
CUUCUCCACAGGAGUCAGAUGUUUUUGUACUCU-CAAGAUUUAAGUAACUGUACA ACGAAACUUA-CACAGUUACUUAAAUCUUGCAGAAGCUA-CAAAGAUAAGGCUUCA
UGCCGAAAUCAACACCCUGU-CAUUUUAUGGCAGGGUG (SEQ ID NO: 8);
ACUUCUCCACAGGAGUCAGAUGUUUUUGUACU-CUCAAGAUUUAAGUAACUGUAC AACGAAACUUA-CACAGUUACUUAAAUCUUGCAGAAGCUA-CAAAGAUAAGGCUUC
AUGCCGAAAUCAACACCCUGU-CAUUUUAUGGCAGGGUG (SEQ ID NO: 9); and
GACUUCUCCACAGGAGUCAGAUGUUUUUGUACU-CUCAAGAUUUAAGUAACUGUA CAACGAAACUUA-CACAGUUACUUAAAUCUUGCAGAAGCUA-CAAAGAUAAGGCUU
CAUGCCGAAAUCAACACCCUGU-CAUUUUAUGGCAGGGUG (SEQ ID NO: 10)

In an aspect, a pharmaceutical composition comprising a base editor or a polynucleotide encoding the base editor is provided, wherein the base editor comprises a polynucleotide programmable DNA binding domain and an adenosine deaminase domain described in any one the above-delineated methods, aspects and embodiments; and one or more guide polynucleotides that target the base editor to effect an A•T to G•C alteration of the SNP associated with sickle cell disease, and a pharmaceutically acceptable carrier, vehicle or excipient.

In another aspect, a pharmaceutical composition comprising the cell of the above-delineated aspects and embodiments, and a pharmaceutically acceptable carrier, vehicle or excipient, is provided.

In another aspect, a kit comprising a base editing system comprising the fusion protein of any one of the above-delineated methods, aspects and embodiments is provided. In an embodiment, the kit further comprises a guide RNA comprising a nucleic acid sequence selected from the group consisting of CUUCUCCACAGGAGUCAGAU (SEQ ID NO: 4); ACUUCUCCACAGGAGUCAGAU (SEQ ID NO: 5); and GACUUCUCCACAGGAGUCAGAU (SEQ ID NO: 6).

In another aspect, a kit comprising a base editor or a polynucleotide encoding the base editor is provided, wherein the base editor comprises a polynucleotide programmable DNA binding domain and an adenosine deaminase domain described in any one of the above-delineated methods, aspects and embodiments; and one or more guide polynucleotides that target the base editor to effect an A•T to G•C alteration of the SNP associated with sickle cell disease.

In another aspect, a kit comprising the cell of any one of the above-delineated aspects and embodiments is provided. In an embodiment of the kits, the kit further comprises a package insert with instructions for use.

In an aspect, provided herein is a base editor system comprising a polynucleotide programmable DNA binding domain and at least one base editor domain that comprises an adenosine deaminase variant comprising an alteration at amino acid position 82 or 166 of MSEVEFSHEYWMRH-ALTLAKRARDEREVPVGAVLVLNNRVIGEGWN-RAIGLHDPTAH AEIMALRQGGLVMQNYRLIDATLY-VTFEPCVMCAGAMIHSRIGRVVFGVRNAKTGAA GSLMDVLHYPGMNHRVEITEGILADECAALL-CYFFRMPRQVFNAQKKAQSSTD (SEQ ID NO: 2) and a guide RNA, wherein said guide RNA targets said base editor to effect an alteration of the SNP associated with alpha-1 antitrypsin deficiency. In some embodiments, the adenosine deaminase variant comprises a V82S alteration and/or a T166R alteration. In some embodiments, the adenosine deaminase variant further comprises one or more of the following alterations: Y147T, Y147R, Q154S, Y123H, and Q154R. In some embodiments, the base editor domain comprises an adenosine deaminase heterodimer comprising a wild-type adenosine deaminase domain and an adenosine deaminase variant. In some embodiments, the adenosine deaminase variant is a truncated TadA8 that is missing 1, 2, 3, 4, 5, 6, 7, 8, 9, 10, 11, 12, 13, 14, 15, 6, 17, 18, 19, or 20 N-terminal amino acid residues relative to the full length TadA8. In some embodiments, the adenosine deaminase variant is a truncated TadA8 that is missing 1, 2, 3, 4, 5, 6, 7, 8, 9, 10, 11, 12, 13, 14, 15, 6, 17, 18, 19, or 20 C-terminal amino acid residues relative to the full length TadA8. In some embodiments, the polynucleotide programmable DNA binding domain is a modified *Staphylococcus aureus* Cas9

(SaCas9), *Streptococcus thermophilus* 1 Cas9 (St1Cas9), a modified *Streptococcus pyogenes* Cas9 (SpCas9), or variants thereof. In some embodiments, the polynucleotide programmable DNA binding domain is a variant of SpCas9 having an altered protospacer-adjacent motif (PAM) specificity or specificity for a non-G PAM. In some embodiments, the polynucleotide programmable DNA binding domain is a nuclease inactive Cas9. In some embodiments, the polynucleotide programmable DNA binding domain is a Cas9 nickase.

In an aspect, provided herein is a base editor system comprising one or more guide RNAs and a fusion protein comprising a polynucleotide programmable DNA binding domain comprising the following sequence: EIGKATAKYFFYSNIMNFFKTEITLANGEIRKRPLI-ETNGETGEIVWDKGRDFATVRKVL SMPQVNIVKK-TEVQTGGFSKESILPKRN-SDKLIARKKDWDPKKYGGFMQPTVAYSVLV VAKVEKGKSKKLKSVKELLGITIMERSSFEKNPID-FLEAKGYKEVKKDLIIKLPKYSLFEL ENGRKRMLA-SAKFLQKGNELALPSKYVNFLYLASHYEKLKGSPED-NEQKQLFVEQHK HYLDEIIEQISEFSKRVILADANLDKVLSAYNKHRDK-PIREQAENIIHLFTLTNLGAPRAF KYFDTTIAR-KEYRSTKEVLDATLIHQSITGLY-ETRIDLSQLGGDGGSGGSGGSGGSGGSG GSGGMDKKYSIGLAIGTNSVGWAVIT-DEYKVPSKKFKVLGNTDRHSIKKNLIGALLFDS GETAEATRLKRTARRRYTRRKNRICYLQEIFSNE-MAKVDDSFFHRLEESFLVEEDKKHE RHPIFGNIVDEVAYHEKYPTIYHLRKKLVD-STDKADLRLIYLALAHMIKFRGHFLIEGDL NPDNSDVDKLFIQLVQTYNQLFEENPI-NASGVDAKAILSARLSKSRRLENLIAQLPGEKK NGLFGNLIALSLGLTPNFKSNFDLAEDAKLQLSKD-TYDDDLDNLLAQIGDQYADLFLAA KNLSDAI-LLSDILRVNTEITKAPLSASMIKRYDEHHQDLTLLKA-LVRQQLPEKYKEIFFD QSKNGYAGYIDGGASQEEFYKFIKPILEKMDG-TEELLVKLNREDLLRKQRTFDNGSIPH QIHLGEL-HAILRRQEDFYPFLKDNREKIEKILTFRIPYYVG-PLARGNSRFAWMTRKSEETI TPWNFEEVVDKGASAQSFIERMTNFDKNLP-NEKVLPKHSLLYEYFTVYNELTKVKYVT EGMRKPAFLSGEQKKAIVDLL-FKTNRKVTVKQLKEDYFKKIECFDSVEISGVEDRF-NAS LGTYHDLLKIIKDKDFLDNEENEDILEDI-VLTLTLFEDREMIEERLKTYAHLFDDKVMKQ LKRRRYTGWGRLSRKLINGIRDKQSGKTILD-FLKSDGFANRNFMQLIHDDSLTFKEDIQ KAQVSGQGDSLHEHIANLAGSPAIK-KGILQTVKVVDELVKVMGRHKPENIVIEMAREN QTTQKGQKNSRERMKRIEEGIKEL-GSQILKEHPVENTQLQNEKLYLYYLQNGRDMYVD QELDINRLSDYDVDHIVPQSFLKDDSIDNKVL-TRSDKNRGKSDNVPSEEVVKKMKNYW RQLLNAK-LITQRKFDNLTKAERGGLSELDKAGFIKRQLVE-TRQITKHVAQILDSRMNTK YDENDKLIREVKVITLKSKLVSD-FRKDFQFYKVREINNYHHAHDAYLNAVVGTALIKK YPKLESEFVYGDYKVYDVRKMIAKSEQEGADKR-TADGSEFESPKKKRKV* (SEQ ID NO: 3), wherein the bold sequence indicates sequence derived from Cas9, the italics sequence denotes a linker sequence, and the underlined sequence denotes a bipartite nuclear localization sequence, and at least one base editor domain comprising an adenosine deaminase variant comprising an alteration at amino acid position 82 and/or 166 of MSEVEFSHEYWMRHALTLAKRAR-DEREVPVGAVLVLNNRVIGEGWNRAIGLHDPTAH AEIMALRQGGLVMQNYRLIDATLYVTFEPCVMCAG-AMIHSRIGRVVFGVRNAKTGAA GSLMDVLHY-PGMNHRVEITEGILADECAALLCYFFRM-PRQVFNAQKKAQSSTD (SEQ ID NO: 2), and wherein the one or more guide RNAs target said base editor to effect an alteration of the SNP associated with alpha-1 antitrypsin deficiency.

In one aspect, a cell comprising any one of the above delineated the base editor systems is provided. In some embodiments, the cell is a human cell or a mammalian cell. In some embodiments, the cell is ex vivo, in vivo, or in vitro.

The description and examples herein illustrate embodiments of the present disclosure in detail. It is to be understood that this disclosure is not limited to the particular embodiments described herein and as such can vary. Those of skill in the art will recognize that there are numerous variations and modifications of this disclosure, which are encompassed within its scope.

The invention provides compositions and methods for editing mutations associated with sickle cell disease (SCD). Compositions and articles defined by the invention were isolated or otherwise manufactured in connection with the examples provided below. Other features and advantages of the invention will be apparent from the detailed description, and from the claims. The practice of some embodiments disclosed herein employ, unless otherwise indicated, conventional techniques of immunology, biochemistry, chemistry, molecular biology, microbiology, cell biology, genomics and recombinant DNA, which are within the skill of the art. See for example Sambrook and Green, Molecular Cloning: A Laboratory Manual, 4th Edition (2012); the series Current Protocols in Molecular Biology (F. M. Ausubel, et al. eds.); the series Methods In Enzymology (Academic Press, Inc.), PCR 2: A Practical Approach (M. J. MacPherson, B. D. Hames and G. R. Taylor eds. (1995)), Harlow and Lane, eds. (1988) Antibodies, A Laboratory Manual, and Culture of Animal Cells: A Manual of Basic Technique and Specialized Applications, 6th Edition (R. I. Freshney, ed. (2010)).

The section headings used herein are for organizational purposes only and are not to be construed as limiting the subject matter described.

Although various features of the present disclosure can be described in the context of a single embodiment, the features can also be provided separately or in any suitable combination. Conversely, although the present disclosure can be described herein in the context of separate embodiments for clarity, the present disclosure can also be implemented in a single embodiment. The section headings used herein are for organizational purposes only and are not to be construed as limiting the subject matter described.

The features of the present disclosure are set forth with particularity in the appended claims. A better understanding of the features and advantages of the present will be obtained by reference to the following detailed description that sets forth illustrative embodiments, in which the principles of the disclosure are utilized, and in view of the accompanying drawings as described hereinbelow.

Definitions

The following definitions supplement those in the art and are directed to the current application and are not to be imputed to any related or unrelated case, e.g., to any commonly owned patent or application. Although any methods and materials similar or equivalent to those described herein can be used in the practice for testing of the present disclosure, the preferred materials and methods are described herein. Accordingly, the terminology used herein is for the purpose of describing particular embodiments only and is not intended to be limiting.

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991).

In this application, the use of the singular includes the plural unless specifically stated otherwise. It must be noted that, as used in the specification, the singular forms "a," "an," and "the" include plural references unless the context clearly dictates otherwise. In this application, the use of "or" means "and/or," unless stated otherwise, and is understood to be inclusive. Furthermore, use of the term "including" as well as other forms, such as "include," "includes," and "included," is not limiting.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, unrecited elements or method steps. It is contemplated that any embodiment discussed in this specification can be implemented with respect to any method or composition of the present disclosure, and vice versa. Furthermore, compositions of the present disclosure can be used to achieve methods of the present disclosure.

The term "about" or "approximately" means within an acceptable error range for the particular value as determined by one of ordinary skill in the art, which will depend in part on how the value is measured or determined, i.e., the limitations of the measurement system. For example, "about" can mean within 1 or more than 1 standard deviation, per the practice in the art. Alternatively, "about" can mean a range of up to 20%, up to 10%, up to 5%, or up to 1% of a given value. Alternatively, particularly with respect to biological systems or processes, the term can mean within an order of magnitude, such as within 5-fold or within 2-fold, of a value. Where particular values are described in the application and claims, unless otherwise stated the term "about" meaning within an acceptable error range for the particular value should be assumed.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Reference in the specification to "some embodiments," "an embodiment," "one embodiment" or "other embodiments" means that a particular feature, structure, or characteristic described in connection with the embodiments is included in at least some embodiments, but not necessarily all embodiments, of the present disclosures.

By "adenosine deaminase" is meant a polypeptide or fragment thereof capable of catalyzing the hydrolytic deamination of adenine or adenosine. In some embodiments, the deaminase or deaminase domain is an adenosine deaminase catalyzing the hydrolytic deamination of adenosine to inosine or deoxy adenosine to deoxyinosine. In some embodiments, the adenosine deaminase catalyzes the hydrolytic deamination of adenine or adenosine in deoxyribonucleic acid (DNA). The adenosine deaminases (e.g., engineered adenosine deaminases, evolved adenosine deaminases) provided herein may be from any organism, such as a bacterium. In some embodiments, the adenosine deaminase comprises an alteration in the following sequence:

```
                                              (SEQ ID NO: 2)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD
```

(also termed TadA*7.10).

In some embodiments, TadA*7.10 comprises at least one alteration. In some embodiments, TadA*7.10 comprises an alteration at amino acid 82 and/or 166. In particular embodiments, a variant of the above-referenced sequence comprises one or more of the following alterations: Y147T, Y147R, Q154S, Y123H, V82S, T166R, and/or Q154R. In other embodiments, a variant of the TadA7.10 sequence comprises a combination of alterations selected from the following: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In other embodiments, the invention provides adenosine deaminase variants that include deletions, e.g., TadA*8, comprising a deletion of the C terminus beginning at residue 149, 150, 151, 152, 153, 154, 155, 156, or 157. In other embodiments, the adenosine deaminase variant is a TadA (e.g., TadA*8) monomer comprising one or more of the following alterations: Y147T, Y147R, Q154S, Y123H, V82S, T166R, and/or Q154R. In other embodiments, the adenosine deaminase variant is a monomer comprising a combination of alterations selected from the following: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In still other embodiments, the adenosine deaminase variant is a homodimer comprising two adenosine deaminase domains (e.g., TadA*8) each having one or more of the following alterations Y147T, Y147R, Q154S, Y123H, V82S, T166R, and/or Q154R. In other embodiments, the adenosine deaminase variant is a homodimer comprising two adenosine deaminase domains (e.g., TadA*8) each having a combination of alterations selected from the group of: Y147T+Q154R; Y147T+Q154S; Y147R+Q154S; V82S+Q154S; V82S+Y147R; V82S+Q154R; V82S+

Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In other embodiments, the adenosine deaminase variant is a heterodimer comprising a wild-type TadA adenosine deaminase domain and an adenosine deaminase variant domain (e.g., TadA*8) comprising one or more of the following alterations Y147T, Y147R, Q154S, Y123H, V82S, T166R, and/or Q154R. In other embodiments, the adenosine deaminase variant is a heterodimer comprising a wild-type TadA adenosine deaminase domain and an adenosine deaminase variant domain (e.g., TadA*8) comprising a combination of alterations selected from the following: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In other embodiments, the adenosine deaminase variant is a heterodimer comprising a TadA*7.10 domain and an adenosine deaminase variant domain (e.g., TadA*8) comprising one or more of the following alterations Y147T, Y147R, Q154S, Y123H, V82S, T166R, and/or Q154R. In other embodiments, the adenosine deaminase variant is a heterodimer comprising a TadA*7.10 domain and an adenosine deaminase variant domain (e.g. TadA*8) comprising a combination of the following alterations: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; or I76Y+V82S+Y123H+Y147R+Q154R.

In one embodiment, the adenosine deaminase is a TadA*8 that comprises or consists essentially of the following sequence or a fragment thereof having adenosine deaminase activity:

(SEQ ID NO: 17)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD.

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In particular embodiments, an adenosine deaminase heterodimer comprises a TadA*8 domain and an adenosine deaminase domain selected from one of the following:

*Staphylococcus aureus* (*S. aureus*) TadA:

(SEQ ID NO: 18)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN

*Bacillus subtilis* (*B. subtilis*) TadA:

(SEQ ID NO: 19)
MTQDELYMKEAIKEAKKAEEKGEVPIGAVLVINGEIIARAHNLRETEQR

SIAHAEMLVIDEACKALGTWRLEGATLYVTLEPCPMCAGAVVLSRVEKV

VFGAFDPKGGCSGTLMNLLQEERFNHQAEVVSGVLEEECGGMLSAFFRE

LRKKKKAARKNLSE

*Salmonella typhimurium* (*S. typhimurium*) TadA:

(SEQ ID NO: 20)
MPPAFITGVTSLSDVELDHEYWMRHALTLAKRAWDEREVPVGAVLVHNH

RVIGEGWNRPIGRHDPTAHAEIMALRQGGLVLQNYRLLDTTLYVTLEPC

VMCAGAMVHSRIGRVVFGARDAKTGAAGSLIDVLHHPGMNHRVEIIEGV

LRDECATLLSDFFRMRRQEIKALKKADRAEGAGPAV

*Shewanella putrefaciens* (*S. putrefaciens*) TadA:

(SEQ ID NO: 21)
MDEYWMQVAMQMAEKAEAAGEVPVGAVLVKDGQQIATGYNLSISQHDPT

AHAEILCLRSAGKKLENYRLLDATLYITLEPCAMCAGAMVHSRIARVVY

GARDEKTGAAGTVVNLLQHPAFNHQVEVTSGVLAEACSAQLSRFFKRRR

DEKKALKLAQRAQQGIE

*Haemophilus influenzae* F3031 (*H. influenzae*) TadA:

(SEQ ID NO: 22)
MDAAKVRSEFDEKMMRYALELADKAEALGEIPVGAVLVDDARNIIGEGW

NLSIVQSDPTAHAEIIALRNGAKNIQNYRLLNSTLYVTLEPCTMCAGAI

LHSRIKRLVFGASDYKTGAIGSRFHFFDDYKMNHTLEITSGVLAEECSQ

KLSTFFQKRREEKKIEKALLKSLSDK

*Caulobacter crescentus* (*C. crescentus*) TadA:

(SEQ ID NO: 23)
MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI

*Geobacter sulfurreducens* (*G. sulfurreducens*) TadA:

(SEQ ID NO: 24)
MSSLKKTPIRDDAYWMGKAIREAAKAAARDEVPIGAVIVRDGAVIGRGH

NLREGSNDPSAHAEMIAIRQAARRSANWRLTGATLYVTLEPCLMCMGAI

ILARLERVVFGCYDPKGGAAGSLYDLSADPRLNHQVRLSPGVCQEECGT

-continued

MLSDFFRDLRRRKKAKATPALFIDERKVPPEP

TadA*7.10

(SEQ ID NO: 2)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD

By "Adenosine Deaminase Base Editor 8 (ABE8) polypeptide" is meant a base editor (BE) as defined and/or described herein comprising an adenosine deaminase variant comprising an alteration at amino acid position 82 and/or 166 of the following reference sequence: MSEVEFSHEYWMRHALTLAKRAR-DEREVPVGAVLVLNNRVIGEGWNRAIGLHDPTAH AEIMALRQGGLVMQNYRLIDATLYVTFEPCVMCAG-AMIHSRIGRVVFGVRNAKTGAA GSLMDVLHY-PGMNHRVEITEGILADECAALLCYFFRM-PRQVFNAQKKAQSSTD (SEQ ID NO: 2). In some embodiments, ABE8 comprises further alterations relative to the reference sequence.

By "Adenosine Deaminase Base Editor 8 (ABE8) polynucleotide" is meant a polynucleotide (polynucleotide sequence) encoding an ABE8 polypeptide.

"Administering" is referred to herein as providing one or more compositions described herein to a patient or a subject. By way of example and without limitation, composition administration, e.g., injection, can be performed by intravenous (i.v.) injection, sub-cutaneous (s.c.) injection, intradermal (i.d.) injection, intraperitoneal (i.p.) injection, or intramuscular (i.m.) injection. One or more such routes can be employed. Parenteral administration can be, for example, by bolus injection or by gradual perfusion over time. Alternatively, or concurrently, administration can be by the oral route.

By "agent" is meant any small molecule chemical compound, antibody, nucleic acid molecule, or polypeptide, or fragments thereof.

By "alteration" is meant a change (e.g. increase or decrease) in the structure, expression levels or activity of a gene or polypeptide as detected by standard art known methods such as those described herein. As used herein, an alteration includes a change in a polynucleotide or polypeptide sequence or a change in expression levels, such as a 25% change, a 40% change, a 50% change, or greater.

By "ameliorate" is meant decrease, suppress, attenuate, diminish, arrest, or stabilize the development or progression of a disease.

By "analog" is meant a molecule that is not identical but has analogous functional or structural features. For example, a polynucleotide or polypeptide analog retains the biological activity of a corresponding naturally-occurring polynucleotide or polypeptide while having certain modifications that enhance the analog's function relative to a naturally occurring polynucleotide or polypeptide. Such modifications could increase the analog's affinity for DNA, efficiency, specificity, protease or nuclease resistance, membrane permeability, and/or half-life, without altering, for example, ligand binding. An analog may include an unnatural nucleotide or amino acid.

By "base editor (BE)" or "nucleobase editor (NBE)" is meant an agent that binds a polynucleotide and has nucleobase modifying activity. In various embodiment, the base editor comprises a nucleobase modifying polypeptide (e.g., a deaminase) and a nucleic acid programmable nucleotide binding domain in conjunction with a guide polynucleotide (e.g., guide RNA). In various embodiments, the agent is a biomolecular complex comprising a protein domain having base editing activity, i.e., a domain capable of modifying a base (e.g., A, T, C, G, or U) within a nucleic acid molecule (e.g., DNA). In some embodiments, the polynucleotide programmable DNA binding domain is fused or linked to a deaminase domain. In one embodiment, the agent is a fusion protein comprising a domain having base editing activity. In another embodiment, the protein domain having base editing activity is linked to the guide RNA (e.g., via an RNA binding motif on the guide RNA and an RNA binding domain fused to the deaminase). In some embodiments, the domain having base editing activity is capable of deaminating a base within a nucleic acid molecule. In some embodiments, the base editor is capable of deaminating one or more bases within a DNA molecule. In some embodiments, the base editor is capable of deaminating an adenosine (A) within DNA. In some embodiments, the base editor is an adenosine base editor (ABE).

In some embodiments, base editors are generated (e.g. ABE8) by cloning an adenosine deaminase variant (e.g., TadA*8) into a scaffold that includes a circular permutant Cas9 (e.g., spCAS9 or saCAS9) and a bipartite nuclear localization sequence. Circular permutant Cas9s are known in the art and described, for example, in Oakes et al., Cell 176, 254-267, 2019. Exemplary circular permutants follow where the bold sequence indicates sequence derived from Cas9, the italics sequence denotes a linker sequence, and the underlined sequence denotes a bipartite nuclear localization sequence.

CP5 (with MSP "NGC=Pam Variant with mutations Regular Cas9 likes NGG" PID=Protein Interacting Domain and "D10A" nickase):

(SEQ ID NO: 3)
EIGKATAKYFFYSNIMNFFKTEITLANGEIRKRPLIETNGETGEIVWD

KGRDFATVRKVLSMPQVNIVKKTEVQTGGFSKESILPKRNSDKLIARK

KDWDPKKYGGFMQPTVAYSVLVVAKVEKGKSKKLKSVKELLGITIMER

SSFEKNPIDFLEAKGYKEVKKDLIIKLPKYSLFELENGRKRMLASAKF

LQKGNELALPSKYVNFLYLASHYEKLKGSPEDNEQKQLFVEQHKHYLD

EIIEQISEFSKRVILADANLDKVLSAYNKHRDKPIREQAENIIHLFTL

TNLGAPRAFKYFDTTIARKEYRSTKEVLDATLIHQSITGLYETRIDLS

QLGGD*GGSGGSGGSGGSGGSGGSGGM*DKKYSIGLAIGTNSVGWAVITD

EYKVPSKKFEWLGNTDRHSIKKNLIGALLFDSGETAEATRLKRTARRR

YTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGH

FLIEGDLNPDNSDVDKLFIQLVQTYNQLFEENPINASGVDAKAILSAR

LSKSRRLENLIAQLPGEKKNGLFGNLIALSLGLTPNFKSNFDLAEDAK

LQLSKDTYDDDLDNLLAQIGDQYADLFLAAKNLSDAILLSDILRVNTE

ITKAPLSASMIKRYDEHHQDLTLLKALVRQQLPEKYKEIFFDQSIMGY

-continued
```
AGYIDGGASQEEFYKFIKPILEKMDGTEELLVKLNREDLLRKQRTFDN

GSIPHQIHLGELHAILRRQEDFYPFLKDNREKIEKILTFRIPYYVGPL

ARGNSRFAWMTRKSEETITPWNFEEVVDKGASAQSFIERMTNFDKNLP

NEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLK

IIKDKDFLDNEENEDILEDIVLTLTLFEDREMIEERLKTYAHLFDDKV

MKQLKRRRYTGWGRLSRKLINGIRDKQSGKTILDFLKSDGFANRNFMQ

LIHDDSLTFKEDIQKAQVSGQGDSLHEHIANLAGSPAIKKGILQTVKV

VDELVKVMGRHKPENIVIEMARENQTTQKGQKNSRERMKRIEEGIKEL

GSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLL

NAKLITQRKFDNLTKAERGGLSELDKAGFIKRQLVETRQITKHVAQIL

DSRMNTKYDENDKLIREVKVITLKSKLVSDFRKDFQFYKVREINNYHH

AHDAYLNAVVGTALIKKYPKLESEFVYGDYKVYDVRKMIAKSEQEGAD

KRTADGSEFESPKKKRKV*
```

In some embodiments, the ABE8 is selected from a base editor from Table 6-9, 13, or 14 infra. In some embodiments, ABE8 contains an adenosine deaminase variant evolved from TadA. In some embodiments, the adenosine deaminase variant of ABE8 is a TadA*8 variant as described in Table 7, 9, 13 or 14 infra. In some embodiments, the adenosine deaminase variant is TadA*7.10 variant (e.g. TadA*8) comprising one or more of an alteration selected from the group of Y147T, Y147R, Q154S, Y123H, V82S, T166R, and/or Q154R. In various embodiments, ABE8 comprises TadA*7.10 variant (e.g. TadA*8) with a combination of alterations selected from the group of Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In some embodiments ABE8 is a monomeric construct. In some embodiments, ABE8 is a heterodimeric construct. In some embodiments, the ABE8 comprises the sequence:

```
(SEQ ID NO: 17)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCT
FFRMPRQVFNAQKKAQSSTD.
```

In some embodiments, the polynucleotide programmable DNA binding domain is a CRISPR associated (e.g., Cas or Cpf1) enzyme. In some embodiments, the base editor is a catalytically dead Cas9 (dCas9) fused to a deaminase domain. In some embodiments, the base editor is a Cas9 nickase (nCas9) fused to a deaminase domain. Details of base editors are described in International PCT Application Nos. PCT/2017/045381 (WO 2018/027078) and PCT/US2016/058344 (WO 2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

By way of example, the adenine base editor (ABE) as used in the base editing compositions, systems and methods described herein has the nucleic acid sequence (8877 base pairs), (Addgene, Watertown, Mass.; Gaudelli N M, et al., Nature. 2017 Nov. 23; 551(7681):464-471. doi: 10.1038/nature24644; Koblan L W, et al., Nat Biotechnol. 2018 October; 36(9):843-846. doi: 10.1038/nbt.4172.) as provided below. Polynucleotide sequences having at least 95% or greater identity to the ABE nucleic acid sequence are also encompassed.

```
                                        (SEQ ID NO: 25)
ATATGCCAAGTACGCCCCCTATTGACGTCAATGAC

GGTAAATGGCCCGCCTGGCATTATGCCCAGTACAT

GACCTTATGGGACTTTCCTACTTGGCAGTACATCT

ACGTATTAGTCATCGCTATTACCATGGTGATGCGG

TTTTGGCAGTACATCAATGGGCGTGGATAGCGGTT

TGACTCACGGGGATTTCCAAGTCTCCACCCCATTG

ACGTCAATGGGAGTTTGTTTTGGCACCAAAATCAA

CGGGACTTTCCAAAATGTCGTAACAACTCCGCCCC

ATTGACGCAAATGGGCGGTAGGCGTGTACGGTGGG

AGGTCTATATAAGCAGAGCTGGTTTAGTGAACCGT

CAGATCCGCTAGAGATCCGCGGCCGCTAATACGAC

TCACTATAGGGAGAGCCGCCACCATGAAACGGACA

GCCGACGGAAGCGAGTTCGAGTCACCAAAGAAGAA

GCGGAAAGTCTCTGAAGTCGAGTTTAGCCACGAGT

ATTGGATGAGGCACGCACTGACCCTGGCAAAGCGA

GCATGGGATGAAAGAGAAGTCCCCGTGGGCGCCGT

GCTGGTGCACAACAATAGAGTGATCGGAGAGGGAT

GGAACAGGCCAATCGGCCGCCACGACCCTACCGCA

CACGCAGAGATCATGGCACTGAGGCAGGGAGGCCT

GGTCATGCAGAATTACCGCCTGATCGATGCCACCC

TGTATGTGACACTGGAGCCATGCGTGATGTGCGCA

GGAGCAATGATCCACAGCAGGATCGGAAGAGTGGT

GTTCGGAGCACGGGACGCCAAGACCGGCGCAGCAG

GCTCCCTGATGGATGTGCTGCACCACCCCGGCATG

AACCACCGGGTGGAGATCACAGAGGGAATCCTGGC

AGACGAGTGCGCCGCCCTGCTGAGCGATTTCTTTA
```

```
GAATGCGGAGACAGGAGATCAAGGCCCAGAAGAAG
GCACAGAGCTCCACCGACTCTGGAGGATCTAGCGG
AGGATCCTCTGGAAGCGAGACACCAGGCACAAGCG
AGTCCGCCACACCAGAGAGCTCCGGCGGCTCCTCC
GGAGGATCCTCTGAGGTGGAGTTTTCCCACGAGTA
CTGGATGAGACATGCCCTGACCCTGGCCAAGAGGG
CACGCGATGAGAGGGAGGTGCCTGTGGGAGCCGTG
CTGGTGCTGAACAATAGAGTGATCGGCGAGGGCTG
GAACAGAGCCATCGGCCTGCACGACCCAACAGCCC
ATGCCGAAATTATGGCCCTGAGACAGGGCGGCCTG
GTCATGCAGAACTACAGACTGATTGACGCCACCCT
GTACGTGACATTCGAGCCTTGCGTGATGTGCGCCG
GCGCCATGATCCACTCTAGGATCGGCCGCGTGGTG
TTTGGCGTGAGGAACGCAAAAACCGGCGCCGCAGG
CTCCCTGATGGACGTGCTGCACTACCCCGGCATGA
ATCACCGCGTCGAAATTACCGAGGGAATCCTGGCA
GATGAATGTGCCGCCCTGCTGTGCTATTTCTTTCG
GATGCCTAGACAGGTGTTCAATGCTCAGAAGAAGG
CCCAGAGCTCCACCGACTCCGGAGGATCTAGCGGA
GGCTCCTCTGGCTCTGAGACACCTGGCACAAGCGA
GAGCGCAACACCTGAAAGCAGCGGGGGCAGCAGCG
GGGGGTCAGACAAGAAGTACAGCATCGGCCTGGCC
ATCGGCACCAACTCTGTGGGCTGGGCCGTGATCAC
CGACGAGTACAAGGTGCCCAGCAAGAAATTCAAGG
TGCTGGGCAACACCGACCGGCACAGCATCAAGAAG
AACCTGATCGGAGCCCTGCTGTTCGACAGCGGCGA
AACAGCCGAGGCCACCCGGCTGAAGAGAACCGCCA
GAAGAAGATACACCAGACGGAAGAACCGGATCTGC
TATCTGCAAGAGATCTTCAGCAACGAGATGGCCAA
GGTGGACGACAGCTTCTTCCACAGACTGGAAGAGT
CCTTCCTGGTGGAAGAGGATAAGAAGCACGAGCGG
CACCCCATCTTCGGCAACATCGTGGACGAGGTGGC
CTACCACGAGAAGTACCCCACCATCTACCACCTGA
GAAAGAAACTGGTGGACAGCACCGACAAGGCCGAC
CTGCGGCTGATCTATCTGGCCCTGGCCCACATGAT
CAAGTTCCGGGGCCACTTCCTGATCGAGGGCGACC
TGAACCCCGACAACAGCGACGTGGACAAGCTGTTC
ATCCAGCTGGTGCAGACCTACAACCAGCTGTTCGA
GGAAAACCCCATCAACGCCAGCGGCGTGGACGCCA
AGGCCATCCTGTCTGCCAGACTGAGCAAGAGCAGA
CGGCTGGAAAATCTGATCGCCCAGCTGCCCGGCGA
```

```
GAAGAAGAATGGCCTGTTCGGAAACCTGATTGCCC
TGAGCCTGGGCCTGACCCCCAACTTCAAGAGCAAC
TTCGACCTGGCCGAGGATGCCAAACTGCAGCTGAG
CAAGGACACCTACGACGACGACCTGGACAACCTGC
TGGCCCAGATCGGCGACCAGTACGCCGACCTGTTT
CTGGCCGCCAAGAACCTGTCCGACGCCATCCTGCT
GAGCGACATCCTGAGAGTGAACACCGAGATCACCA
AGGCCCCCCTGAGCGCCTCTATGATCAAGAGATAC
GACGAGCACCACCAGGACCTGACCCTGCTGAAAGC
TCTCGTGCGGCAGCAGCTGCCTGAGAAGTACAAAG
AGATTTTCTTCGACCAGAGCAAGAACGGCTACGCC
GGCTACATTGACGGCGGAGCCAGCCAGGAAGAGTT
CTACAAGTTCATCAAGCCCATCCTGGAAAAGATGG
ACGGCACCGAGGAACTGCTCGTGAAGCTGAACAGA
GAGGACCTGCTGCGGAAGCAGCGGACCTTCGACAA
CGGCAGCATCCCCCACCAGATCCACCTGGGAGAGC
TGCACGCCATTCTGCGGCGGCAGGAAGATTTTTAC
CCATTCCTGAAGGACAACCGGGAAAAGATCGAGAA
GATCCTGACCTTCCGCATCCCCTACTACGTGGGCC
CTCTGGCCAGGGGAAACAGCAGATTCGCCTGGATG
ACCAGAAAGAGCGAGGAAACCATCACCCCCTGGAA
CTTCGAGGAAGTGGTGGACAAGGGCGCTTCCGCCC
AGAGCTTCATCGAGCGGATGACCAACTTCGATAAG
AACCTGCCCAACGAGAAGGTGCTGCCCAAGCACAG
CCTGCTGTACGAGTACTTCACCGTGTATAACGAGC
TGACCAAAGTGAAATACGTGACCGAGGGAATGAGA
AAGCCCGCCTTCCTGAGCGGCGAGCAGAAAAAGGC
CATCGTGGACCTGCTGTTCAAGACCAACCGGAAAG
TGACCGTGAAGCAGCTGAAAGAGGACTACTTCAAG
AAAATCGAGTGCTTCGACTCCGTGGAAATCTCCGG
CGTGGAAGATCGGTTCAACGCCTCCCTGGGCACAT
ACCACGATCTGCTGAAAATTATCAAGGACAAGGAC
TTCCTGGACAATGAGGAAAACGAGGACATTCTGGA
AGATATCGTGCTGACCCTGACACTGTTTGAGGACA
GAGAGATGATCGAGGAACGGCTGAAAACCTATGCC
CACCTGTTCGACGACAAAGTGATGAAGCAGCTGAA
GCGGCGGAGATACACCGGCTGGGGCAGGCTGAGCC
GGAAGCTGATCAACGGCATCCGGGACAAGCAGTCC
GGCAAGACAATCCTGGATTTCCTGAAGTCCGACGG
CTTCGCCAACAGAAACTTCATGCAGCTGATCCACG
```

-continued

ACGACAGCCTGACCTTTAAAGAGGACATCCAGAAA
GCCCAGGTGTCCGGCCAGGGCGATAGCCTGCACGA
GCACATTGCCAATCTGGCCGGCAGCCCCGCCATTA
AGAAGGGCATCCTGCAGACAGTGAAGGTGGTGGAC
GAGCTCGTGAAAGTGATGGGCCGGCACAAGCCCGA
GAACATCGTGATCGAAATGGCCAGAGAGAACCAGA
CCACCCAGAAGGGACAGAAGAACAGCCGCGAGAGA
ATGAAGCGGATCGAAGAGGGCATCAAAGAGCTGGG
CAGCCAGATCCTGAAAGAACACCCCGTGGAAAACA
CCCAGCTGCAGAACGAGAAGCTGTACCTGTACTAC
CTGCAGAATGGGCGGGATATGTACGTGGACCAGGA
ACTGGACATCAACCGGCTGTCCGACTACGATGTGG
ACCATATCGTGCCTCAGAGCTTTCTGAAGGACGAC
TCCATCGACAACAAGGTGCTGACCAGAAGCGACAA
GAACCGGGCAAGAGCGACAACGTGCCCTCCGAAG
AGGTCGTGAAGAAGATGAAGAACTACTGGCGGCAG
CTGCTGAACGCCAAGCTGATTACCCAGAGAAAGTT
CGACAATCTGACCAAGGCCGAGAGAGGCGGCCTGA
GCGAACTGGATAAGGCCGGCTTCATCAAGAGACAG
CTGGTGGAAACCCGGCAGATCACAAAGCACGTGGC
ACAGATCCTGGACTCCCGGATGAACACTAAGTACG
ACGAGAATGACAAGCTGATCCGGGAAGTGAAAGTG
ATCACCCTGAAGTCCAAGCTGGTGTCCGATTTCCG
GAAGGATTTCCAGTTTTACAAAGTGCGCGAGATCA
ACAACTACCACCACGCCCACGACGCCTACCTGAAC
GCCGTCGTGGGAACCGCCCTGATCAAAAAGTACCC
TAAGCTGGAAAGCGAGTTCGTGTACGGCGACTACA
AGGTGTACGACGTGCGGAAGATGATCGCCAAGAGC
GAGCAGGAAATCGGCAAGGCTACCGCCAAGTACTT
CTTCTACAGCAACATCATGAACTTTTTCAAGACCG
AGATTACCCTGGCCAACGGCGAGATCCGGAAGCGG
CCTCTGATCGAGACAAACGGCGAAACCGGGGAGAT
CGTGTGGGATAAGGGCCGGGATTTTGCCACCGTGC
GGAAAGTGCTGAGCATGCCCCAAGTGAATATCGTG
AAAAAGACCGAGGTGCAGACAGGCGGCTTCAGCAA
AGAGTCTATCCTGCCCAAGAGGAACAGCGATAAGC
TGATCGCCAGAAAGAAGGACTGGGACCCTAAGAAG
TACGGCGGCTTCGACAGCCCCACCGTGGCCTATTC
TGTGCTGGTGGTGGCCAAAGTGGAAAAGGGCAAGT
CCAAGAAACTGAAGAGTGTGAAAGAGCTGCTGGGG
ATCACCATCATGGAAAGAAGCAGCTTCGAGAAGAA

-continued

TCCCATCGACTTTCTGGAAGCCAAGGGCTACAAAG
AAGTGAAAAAGGACCTGATCATCAAGCTGCCTAAG
TACTCCCTGTTCGAGCTGGAAAACGGCCGGAAGAG
AATGCTGGCCTCTGCCGGCGAACTGCAGAAGGGAA
ACGAACTGGCCCTGCCCTCCAAATATGTGAACTTC
CTGTACCTGGCCAGCCACTATGAGAAGCTGAAGGG
CTCCCCCGAGGATAATGAGCAGAAACAGCTGTTTG
TGGAACAGCACAAGCACTACCTGGACGAGATCATC
GAGCAGATCAGCGAGTTCTCCAAGAGAGTGATCCT
GGCCGACGCTAATCTGGACAAAGTGCTGTCCGCCT
ACAACAAGCACCGGGATAAGCCCATCAGAGAGCAG
GCCGAGAATATCATCCACCTGTTTACCCTGACCAA
TCTGGGAGCCCCTGCCGCCTTCAAGTACTTTGACA
CCACCATCGACCGGAAGAGGTACACCAGCACCAAA
GAGGTGCTGGACGCCACCCTGATCCACCAGAGCAT
CACCGGCCTGTACGAGACACGGATCGACCTGTCTC
AGCTGGGAGGTGACTCTGGCGGCTCAAAAAGAACC
GCCGACGGCAGCGAATTCGAGCCCAAGAAGAAGAG
GAAAGTCTAACCGGTCATCATCACCATCACCATTG
AGTTTAAACCCGCTGATCAGCCTCGACTGTGCCTT
CTAGTTGCCAGCCATCTGTTGTTTGCCCCTCCCCC
GTGCCTTCCTTGACCCTGGAAGGTGCCACTCCCAC
TGTCCTTTCCTAATAAAATGAGGAAATTGCATCGC
ATTGTCTGAGTAGGTGTCATTCTATTCTGGGGGGT
GGGGTGGGGCAGGACAGCAAGGGGGAGGATTGGGA
AGACAATAGCAGGCATGCTGGGGATGCGGTGGGCT
CTATGGCTTCTGAGGCGGAAAGAACCAGCTGGGGC
TCGATACCGTCGACCTCTAGCTAGAGCTTGGCGTA
ATCATGGTCATAGCTGTTTCCTGTGTGAAATTGTT
ATCCGCTCACAATTCCACACAACATACGAGCCGGA
AGCATAAAGTGTAAAGCCTAGGGTGCCTAATGAGT
GAGCTAACTCACATTAATTGCGTTGCGCTCACTGC
CCGCTTTCCAGTCGGGAAACCTGTCGTGCCAGCTG
CATTAATGAATCGGCCAACGCGCGGGGAGAGGCGG
TTTGCGTATTGGGCGCTCTTCCGCTTCCTCGCTCA
CTGACTCGCTGCGCTCGGTCGTTCGGCTGCGGCGA
GCGGTATCAGCTCACTCAAAGGCGGTAATACGGTT
ATCCACAGAATCAGGGGATAACGCAGGAAAGAACA
TGTGAGCAAAAGGCCAGCAAAAGGCCAGGAACCGT
AAAAAGGCCGCGTTGCTGGCGTTTTTCCATAGGCT

CCGCCCCCTGACGAGCATCACAAAAATCGACGCT

CAAGTCAGAGGTGGCGAAACCCGACAGGACTATAA

AGATACCAGGCGTTTCCCCCTGGAAGCTCCCTCGT

GCGCTCTCCTGTTCCGACCCTGCCGCTTACCGGAT

ACCTGTCCGCCTTTCTCCCTTCGGGAAGCGTGGCG

CTTTCTCATAGCTCACGCTGTAGGTATCTCAGTTC

GGTGTAGGTCGTTCGCTCCAAGCTGGGCTGTGTGC

ACGAACCCCCCGTTCAGCCCGACCGCTGCGCCTTA

TCCGGTAACTATCGTCTTGAGTCCAACCCGGTAAG

ACACGACTTATCGCCACTGGCAGCAGCCACTGGTA

ACAGGATTAGCAGAGCGAGGTATGTAGGCGGTGCT

ACAGAGTTCTTGAAGTGGTGGCCTAACTACGGCTA

CACTAGAAGAACAGTATTTGGTATCTGCGCTCTGC

TGAAGCCAGTTACCTTCGGAAAAAGAGTTGGTAGC

TCTTGATCCGGCAAACAACCACCGCTGGTAGCGG

TGGTTTTTTTGTTTGCAAGCAGCAGATTACGCGCA

GAAAAAAGGATCTCAAGAAGATCCTTTGATCTTT

TCTACGGGGTCTGACACTCAGTGGAACGAAAACTC

ACGTTAAGGGATTTTGGTCATGAGATTATCAAAAA

GGATCTTCACCTAGATCCTTTTAAATTAAAAATGA

AGTTTTAAATCAATCTAAAGTATATATGAGTAAAC

TTGGTCTGACAGTTACCAATGCTTAATCAGTGAGG

CACCTATCTCAGCGATCTGTCTATTTCGTTCATCC

ATAGTTGCCTGACTCCCCGTCGTGTAGATAACTAC

GATACGGGAGGGCTTACCATCTGGCCCCAGTGCTG

CAATGATACCGCGAGACCCACGCTCACCGGCTCCA

GATTTATCAGCAATAAACCAGCCAGCCGGAAGGGC

CGAGCGCAGAAGTGGTCCTGCAACTTTATCCGCCT

CCATCCAGTCTATTAATTGTTGCCGGGAAGCTAGA

GTAAGTAGTTCGCCAGTTAATAGTTTGCGCAACGT

TGTTGCCATTGCTACAGGCATCGTGGTGTCACGCT

CGTCGTTTGGTATGGCTTCATTCAGCTCCGGTTCC

CAACGATCAAGGCGAGTTACATGATCCCCCATGTT

GTGCAAAAAAGCGGTTAGCTCCTTCGGTCCTCCGA

TCGTTGTCAGAAGTAAGTTGGCCGCAGTGTTATCA

CTCATGGTTATGGCAGCACTGCATAATTCTCTTAC

TGTCATGCCATCCGTAAGATGCTTTTCTGTGACTG

GTGAGTACTCAACCAAGTCATTCTGAGAATAGTGT

ATGCGGCGACCGAGTTGCTCTTGCCCGGCGTCAAT

ACGGGATAATACCGCGCCACATAGCAGAACTTTAA

AAGTGCTCATCATTGGAAAACGTTCTTCGGGGCGA

AAACTCTCAAGGATCTTACCGCTGTTGAGATCCAG

TTCGATGTAACCCACTCGTGCACCCAACTGATCTT

CAGCATCTTTTACTTTCACCAGCGTTTCTGGGTGA

GCAAAAACAGGAAGGCAAAATGCCGCAAAAAAGGG

AATAAGGGCGACACGGAAATGTTGAATACTCATAC

TCTTCCTTTTTCAATATTATTGAAGCATTTATCAG

GGTTATTGTCTCATGAGCGGATACATATTTGAATG

TATTTAGAAAAATAAACAAATAGGGGTTCCGCGCA

CATTTCCCCGAAAAGTGCCACCTGACGTCGACGGA

TCGGGAGATCGATCTCCCGATCCCCTAGGGTCGAC

TCTCAGTACAATCTGCTCTGATGCCGCATAGTTAA

GCCAGTATCTGCTCCCTGCTTGTGTGTTGGAGGTC

GCTGAGTAGTGCGCGAGCAAAATTTAAGCTACAAC

AAGGCAAGGCTTGACCGACAATTGCATGAAGAATC

TGCTTAGGGTTAGGCGTTTTGCGCTGCTTCGCGAT

GTACGGGCCAGATATACGCGTTGACATTGATTATT

GACTAGTTATTAATAGTAATCAATTACGGGGTCAT

TAGTTCATAGCCCATATATGGAGTTCCGCGTTACA

TAACTTACGGTAAATGGCCCGCCTGGCTGACCGCC

CAACGACCCCCGCCCATTGACGTCAATAATGACGT

ATGTTCCCATAGTAACGCCAATAGGGACTTTCCAT

TGACGTCAATGGGTGGAGTATTTACGGTAAACTGC

CCACTTGGCAGTACATCAAGTGTATC

By "base editing activity" is meant acting to chemically alter a base within a polynucleotide. In one embodiment, a first base is converted to a second base. In one embodiment, the base editing activity is adenosine or adenine deaminase activity, e.g., converting A•T to G•C. In some embodiments, base editing activity is assessed by efficiency of editing. Base editing efficiency may be measured by any suitable means, for example, by sanger sequencing or next generation sequencing. In some embodiments, base editing efficiency is measured by percentage of total sequencing reads with nucleobase conversion effected by the base editor, for example, percentage of total sequencing reads with target A.T base pair converted to a G.C base pair. In some embodiments, base editing efficiency is measured by percentage of total cells with nucleobase conversion effected by the base editor, when base editing is performed in a population of cells.

The term "base editor system" refers to a system for editing a nucleobase of a target nucleotide sequence. In various embodiments, the base editor system comprises (1) a polynucleotide programmable nucleotide binding domain (e.g. Cas9); (2) a deaminase domain (e.g. an adenosine deaminase) for deaminating said nucleobase; and (3) one or more guide polynucleotide (e.g., guide RNA). In some embodiments, the polynucleotide programmable nucleotide binding domain is a polynucleotide programmable DNA binding domain. In some embodiments, the base editor is an adenine or adenosine base editor (ABE). In some embodiments, the base editor system is ABE8.

In some embodiments, a base editor system may comprise more than one base editing component. For example, a base editor system may include more than one deaminase. In some embodiments, a base editor system may include one or more adenosine deaminases. In some embodiments, a single guide polynucleotide may be utilized to target different deaminases to a target nucleic acid sequence. In some embodiments, a single pair of guide polynucleotides may be utilized to target different deaminases to a target nucleic acid sequence.

The deaminase domain and the polynucleotide programmable nucleotide binding component of a base editor system may be associated with each other covalently or non-covalently, or any combination of associations and interactions thereof. For example, in some embodiments, a deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the deaminase domain can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or a RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the deaminase domain can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a BER inhibitor. In some embodiments, the inhibitor of BER can be a uracil DNA glycosylase inhibitor (UGI). In some embodiments, the inhibitor of BER can be an inosine BER inhibitor. In some embodiments, the inhibitor of BER can be targeted to the target nucleotide sequence by the polynucleotide programmable nucleotide binding domain. In some embodiments, a polynucleotide programmable nucleotide binding domain can be fused or linked to an inhibitor of BER. In some embodiments, a polynucleotide programmable nucleotide binding domain can be fused or linked to a deaminase domain and an inhibitor of BER. In some embodiments, a polynucleotide programmable nucleotide binding domain can target an inhibitor of BER to a target nucleotide sequence by non-covalently interacting with or associating with the inhibitor of BER. For example, in some embodiments, the inhibitor of BER component can comprise an additional heterologous portion or domain that is capable of interacting with, associating with, or capable of forming a complex with an additional heterologous portion or domain that is part of a polynucleotide programmable nucleotide binding domain.

In some embodiments, the inhibitor of BER can be targeted to the target nucleotide sequence by the guide polynucleotide. For example, in some embodiments, the inhibitor of BER can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of BER. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

By "β-globin (HBB) protein" is meant a polypeptide or fragment thereof having at least about 95% amino acid sequence identity to NCBI Accession No. NP_000509. In particular embodiments, a β-globin protein comprises one or more alterations relative to the following reference sequence. In one particular embodiment, a β-globin protein associated with sickle cell disease comprises an E6V (also termed E7V) mutation. An exemplary β-globin amino acid sequence is provided below.

```
                                                       (SEQ ID NO: 26)
  1  MVHLTPEEKS AVTALWGKVN VDEVGGEALG RLLVVYPWTQ RFFESFGDLS TPDAVMGNPK

61  VKAHGKKVLG AFSDGLAHLD NLKGTFATLS ELHCDKLHVD PENFRLLGNV LVCVLAHHFG

121  KEFTPPVQAA YQKVVAGVAN ALAHKYH
```

By "HBB polynucleotide" is meant a nucleic acid molecule encoding β-globin protein or fragment thereof. The sequence of an exemplary HBB polynucleotide, which is available at NCBI Accession No. NM 000518, is provided below:

```
                                                       (SEQ ID NO: 27)
  1  acatttgctt ctgacacaac tgtgttcact agcaacctca aacagacacc atggtgcatc 61  tgactcctga ggagaagtct gccgttactg ccctgtgggg caaggtgaac gtggatgaag 121  ttggtggtga ggccctgggc aggctgctgg tggtctaccc ttggacccag aggttctttg 181  agtcctttgg ggatctgtcc actcctgatg ctgttatggg caaccctaag gtgaaggctc 241  atggcaagaa agtgctcggt gcctttagtg atggcctggc tcacctggac aacctcaagg 301  gcacctttgc cacactgagt gagctgcact gtgacaagct gcacgtggat cctgagaact 361  tcaggctcct gggcaacgtg ctggtctgtg tgctggccca tcactttggc aaagaattca 421  ccccaccagt gcaggctgcc tatcagaaag tggtggctgg tgtggctaat gccctggccc 481  acaagtatca ctaagctcgc tttcttgctg tccaatttct attaaaggtt cctttgttcc 541  ctaagtccaa ctactaaact gggggatatt atgaagggcc ttgagcatct ggattctgcc 601  taataaaaaa catttatttt cattgcaa
```

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a Casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) *RNA Biology* 10:5, 726-737; the entire contents of which are incorporated herein by reference.

An exemplary Cas9, is *Streptococcus pyogenes* Cas9 (spCas9), the amino acid sequence of which is provided below:

(SEQ ID NO: 28)
MDKK<u>YSIGLDIGTNSVGWAVITDDYKVPSKKFKVLGNTDRHSIKKNLI</u>

<u>GALLFGSGETAEATRLKRTARRRYTRRKNRICYLQEIFSNEMAKVDDS</u>

FFHRLEESFLVEEDKKHERHPIFGNIVDEVAYHEKYPTIYHLRKKLAD

STDKADLRLIYLALAHMIKFRGHFLIEGDLNPDNSDVDKLFIQLVQIY

NQLFEENPINASRVDAKAILSARLSKSRRLENLIAQLPGEKRNGLFGN

LIALSLGLTPNFKSNFDLAEDAKLQLSKDTYDDDLDNLLAQIGDQYAD

LFLAAKNLSDAILLSDILRVNSEITKAPLSASMIKRYDEHHQDLTLLK

ALVRQQLPEKYKEIFFDQSKNGYAGYIDGGASQEEFYKFIKPILEKMD

GTEELLVKLNREDLLRKQRTFDNGSIPHQIHLGELHAILRRQEDFYPF

LKDNREKIEKILTFRIPYYVGPLARGNSRFAWMTRKSEETITPWNFEE

VVDKGASAQSFIERMTNFDKNLPNEKVLPKHSLLYEYFTVYNELTKVK

YVTEGMRKPAFLSGEQKKAIVDLLFKTNRKVTVKQLKEDYFKKIECFD

SVEISGVEDRFNASLGAYHDLLKIIKDKDFLDNEENEDILEDIVLTLT

LFEDRGMIEERLKTYAHLFDDKVMKQLKRRRYTGWGRLSRKLINGIRD

KQSGKTILDFLKSDGFANRNFMQLIHDDSLTFKEDIQKAQVSGQG<u>HSL</u>

<u>HEQIANLAGSPAIKKGILQTVKIVDELVKVMGHKPENIVIEMA</u>ENQT

TQKGQ<u>KNSRERMKRIEEGIKELGSQILKEHPVENTQLQNEKLYLYYLQ</u>

<u>NGRDMYVDQELDINRLSDYDVDHIVPQSFIKDDSIDNKVLTRSDKNRG</u>

<u>KSDNVPSEEVVKKMKNYWRQLLNAKLITQRKFDNLTKAERGGLSELDK</u>

<u>AGFIKRQLVETRQITKHVAQILDSRMNTKYDENDKLIREVKVITLKSK</u>

<u>LVSDFRKDFQFYKVREINNYHHAHDAYLNAVVGTALIKKYPKLESEFV</u>

<u>YGDYKVYDVRKMIAKSEQEIGKATAKYFFYSNIMNFFKTEITLANGEI</u>

<u>RKRPLIETNGETGEIVWDKGRDFATVRKVLSMPQVNIVKKTEVQTGGF</u>

SKESILPKRNSDKLIARKKDWDPKKYGGFDSPTVAYSVLVVAKVEKGK

SKKLKSVKELLGITIMERSSFEKNPIDFLEAKGYKEVKKDLIIKLPKY

SLFELENGRKRMLASAGELQKGNELALPSKYVNFLYLASHYEKLKGSP

EDNEQKQLFVEQHKHYLDEIIEQISEFSKRVILADANLDKVLSAYNKH

RDKPIREQAENIIHLFTLTNLGAPAAFKYFDTTIDRKRYTSTKEVLDA

TLIHQSITGLYETRIDLSQLGGD (single underline: HNH domain; double underline: RuvC domain)

A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science*. 337:816-821 (2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821 (2012); Qi et al., *Cell*. 28; 152(5):1173-83 (2013)). In some embodiments, a Cas9 nuclease has an inactive (e.g., an inactivated) DNA cleavage domain, that is, the Cas9 is a nickase, referred to as an "nCas9" protein (for "nickase" Cas9).

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length. In some embodiments, wild-type Cas9 corresponds to Cas9 from *Streptococcus pyogenes* (NCBI Reference Sequence: NC_017053.1, nucleotide and amino acid sequences as follows):

(SEQ ID NO: 29)
ATGGATAAGAAATACTCAATAGGCTTAGATATCGGCACAAATAGCGTCGGATGGGCGGTGATCACTGATG

ATTATAAGGTTCCGTCTAAAAAGTTCAAGGTTCTGGGAAATACAGACCGCCACAGTATCAAAAAAATCT

-continued

```
TATAGGGGCTCTTTTATTTGGCAGTGGAGAGACAGCGGAAGCGACTCGTCTCAAACGGACAGCTCGTAGA

AGGTATACACGTCGGAAGAATCGTATTTGTTATCTACAGGAGATTTTTTCAAATGAGATGGCGAAAGTAG

ATGATAGTTTCTTTCATCGACTTGAAGAGTCTTTTTTGGTGGAAGAAGACAAGAAGCATGAACGTCATCC

TATTTTTGGAAATATAGTAGATGAAGTTGCTTATCATGAGAAATATCCAACTATCTATCATCTGCGAAAA

AAATTGGCAGATTCTACTGATAAAGCGGATTTGCGCTTAATCTATTTGGCCTTAGCGCATATGATTAAGT

TTCGTGGTCATTTTTTGATTGAGGGAGATTTAAATCCTGATAATAGTGATGTGGACAAACTATTTATCCA

GTTGGTACAAATCTACAATCAATTATTTGAAGAAAACCCTATTAACGCAAGTAGAGTAGATGCTAAAGCG

ATTCTTTCTGCACGATTGAGTAAATCAAGACGATTAGAAAATCTCATTGCTCAGCTCCCCGGTGAGAAGA

GAAATGGCTTGTTTGGGAATCTCATTGCTTTGTCATTGGGATTGACCCCTAATTTTAAATCAAATTTTGA

TTTGGCAGAAGATGCTAAATTACAGCTTTCAAAAGATACTTACGATGATGATTTAGATAATTTATTGGCG

CAAATTGGAGATCAATATGCTGATTTGTTTTTGGCAGCTAAGAATTTATCAGATGCTATTTTACTTTCAG

ATATCCTAAGAGTAAATAGTGAAATAACTAAGGCTCCCCTATCAGCTTCAATGATTAAGCGCTACGATGA

ACATCATCAAGACTTGACTCTTTTAAAAGCTTTAGTTCGACAACAACTTCCAGAAAAGTATAAAGAAATC

TTTTTTGATCAATCAAAAAACGGATATGCAGGTTATATTGATGGGGGAGCTAGCCAAGAAGAATTTTATA

AATTTATCAAACCAATTTTAGAAAAAATGGATGGTACTGAGGAATTATTGGTGAAACTAAATCGTGAAGA

TTTGCTGCGCAAGCAACGGACCTTTGACAACGGCTCTATTCCCCATCAAATTCACTTGGGTGAGCTGCAT

GCTATTTTGAGAAGACAAGAAGACTTTTATCCATTTTTAAAAGACAATCGTGAGAAGATTGAAAAAATCT

TGACTTTTCGAATTCCTTATTATGTTGGTCCATTGGCGCGTGGCAATAGTCGTTTTGCATGGATGACTCG

GAAGTCTGAAGAAACAATTACCCCATGGAATTTTGAAGAAGTTGTCGATAAAGGTGCTTCAGCTCAATCA

TTTATTGAACGCATGACAAACTTTGATAAAAATCTTCCAAATGAAAAAGTACTACCAAAACATAGTTTGC

TTTATGAGTATTTTACGGTTTATAACGAATTGACAAAGGTCAAATATGTTACTGAGGGAATGCGAAAACC

AGCATTTCTTTCAGGTGAACAGAAGAAAGCCATTGTTGATTTACTCTTCAAAACAAATCGAAAAGTAACC

GTTAAGCAATTAAAAGAAGATTATTTCAAAAAAATAGAATGTTTTGATAGTGTTGAAATTTCAGGAGTTG

AAGATAGATTTAATGCTTCATTAGGCGCCTACCATGATTTGCTAAAAATTATTAAAGATAAAGATTTTTT

GGATAATGAAGAAAATGAAGATATCTTAGAGGATATTGTTTTAACATTGACCTTATTTGAAGATAGGGGG

ATGATTGAGGAAAGACTTAAAACATATGCTCACCTCTTTGATGATAAGGTGATGAAACAGCTTAAACGTC

GCCGTTATACTGGTTGGGGACGTTTGTCTCGAAAATTGATTAATGGTATTAGGGATAAGCAATCTGGCAA

AACAATATTAGATTTTTTGAAATCAGATGGTTTTGCCAATCGCAATTTTATGCAGCTGATCCATGATGAT

AGTTTGACATTTAAAGAAGATATTCAAAAAGCACAGGTGTCTGGACAAGGCCATAGTTTACATGAACAGA

TTGCTAACTTAGCTGGCAGTCCTGCTATTAAAAAAGGTATTTTACAGACTGTAAAAATTGTTGATGAACT

GGTCAAAGTAATGGGGCATAAGCCAGAAAATATCGTTATTGAAATGGCACGTGAAAATCAGACAACTCAA

AAGGGCCAGAAAAATTCGCGAGAGCGTATGAAACGAATCGAAGAAGGTATCAAAGAATTAGGAAGTCAGA

TTCTTAAAGAGCATCCTGTTGAAAATACTCAATTGCAAAATGAAAAGCTCTATCTCTATTATCTACAAAA

TGGAAGAGACATGTATGTGGACCAAGAATTAGATATTAATCGTTTAAGTGATTATGATGTCGATCACATT

GTTCCACAAAGTTTCATTAAAGACGATTCAATAGACAATAAGGTACTAACGCGTTCTGATAAAAATCGTG

GTAAATCGGATAACGTTCCAAGTGAAGAAGTAGTCAAAAAGATGAAAAACTATTGGAGACAACTTCTAAA

CGCCAAGTTAATCACTCAACGTAAGTTTGATAATTTAACGAAAGCTGAACGTGGAGGTTTGAGTGAACTT

GATAAAGCTGGTTTTATCAAACGCCAATTGGTTGAAACTCGCCAAATCACTAAGCATGTGGCACAAATTT

TGGATAGTCGCATGAATACTAAATACGATGAAAATGATAAACTTATTCGAGAGGTTAAAGTGATTACCTT

AAAATCTAAATTAGTTTCTGACTTCCGAAAAGATTTCCAATTCTATAAAGTACGTGAGATTAACAATTAC
```

-continued

```
CATCATGCCCATGATGCGTATCTAAATGCCGTCGTTGGAACTGCTTTGATTAAGAAATATCCAAAACTTG

AATCGGAGTTTGTCTATGGTGATTATAAAGTTTATGATGTTCGTAAAATGATTGCTAAGTCTGAGCAAGA

AATAGGCAAAGCAACCGCAAAATATTTCTTTTACTCTAATATCATGAACTTCTTCAAAACAGAAATTACA

CTTGCAAATGGAGAGATTCGCAAACGCCCTCTAATCGAAACTAATGGGGAAACTGGAGAAATTGTCTGGG

ATAAAGGGCGAGATTTTGCCACAGTGCGCAAAGTATTGTCCATGCCCCAAGTCAATATTGTCAAGAAAAC

AGAAGTACAGACAGGCGGATTCTCCAAGGAGTCAATTTTACCAAAAAGAAATTCGGACAAGCTTATTGCT

CGTAAAAAGACTGGGATCCAAAAAATATGGTGGTTTTGATAGTCCAACGGTAGCTTATTCAGTCCTAG

TGGTTGCTAAGGTGGAAAAAGGGAAATCGAAGAAGTTAAAATCCGTTAAAGAGTTACTAGGGATCACAAT

TATGGAAAGAAGTTCCTTTGAAAAAAATCCGATTGACTTTTTAGAAGCTAAAGGATATAAGGAAGTTAAA

AAAGACTTAATCATTAAACTACCTAAATATAGTCTTTTTGAGTTAGAAAACGGTCGTAAACGGATGCTGG

CTAGTGCCGGAGAATTACAAAAAGGAAATGAGCTGGCTCTGCCAAGCAAATATGTGAATTTTTTATATTT

AGCTAGTCATTATGAAAAGTTGAAGGGTAGTCCAGAAGATAACGAACAAAAACAATTGTTTGTGGAGCAG

CATAAGCATTATTTAGATGAGATTATTGAGCAAATCAGTGAATTTTCTAAGCGTGTTATTTTAGCAGATG

CCAATTTAGATAAAGTTCTTAGTGCATATAACAAACATAGAGACAAACCAATACGTGAACAAGCAGAAAA

TATTATTCATTTATTTACGTTGACGAATCTTGGAGCTCCCGCTGCTTTTAAATATTTTGATACAACAATT

GATCGTAAACGATATACGTCTACAAAAGAAGTTTTAGATGCCACTCTTATCCATCAATCCATCACTGGTC

TTTATGAAACACGCATTGATTTGAGTCAGCTAGGAGGTGACTGA
```

(SEQ ID NO: 28)

MDKK<u>YSIGLDIGTNSVGWAVITDDYKVPSKKFKVLGNTDRHSIKKNLIGALLFGSGET</u>AEATRL

KRTARRRYTRRKNRICYLQEIFSNEMAKVDDSFFHRLEESFLVEEDKKHERHPIFGNIVDEVAY

HEKYPTIYHLRKKLADSTDKADLRLIYLALAHMIKFRGHFLIEGDLNPDNSDVDKLFIQLVQIY

NQLFEENPINASRVDAKAILSARLSKSRRLENLIAQLPGEKRNGLFGNLIALSLGLTPNFKSNF

DLAEDAKLQLSKDTYDDDLDNLLAQIGDQYADLFLAAKNLSDAILLSDILRVNSEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVIVKQLKEDYFKKIECFD

SVEISGVEDRFNASLGAYHDLLKIIKDKDFLDNEENEDILEDIVLTLTLFEDRGMIEERLKTYA

HLFDDKVMKQLKRRRYTGWGRLSRKLINGIRDKQSGKTILDFLKSDGFANRNFMQLIHDDSLTF

KEDIQKAQVSGQG<u>HSLHEQIANLAGSPAIKKGILQTVKIVDELVKVMGHKPENIVIEMARE</u>NQT

TQKGQKNSRERMKRIEEGIKELGSQILKEHPVENTQLQNEKLYLYYLQNGRDMYVDQELDINRL

SDYDVDHIVPQSFIKDDSIDNKVLTRSDKNRGKSDNVPSEEVVKKMKNYWRQLLNAKLITQRKF

DNLTKAERG<u>GLSELDKAGFIKRQLVETRQITKHVAQILDSRMNTKYDENDKLIREVKVITLKSK</u>

<u>LVSDFRKDFQFYKVREINNYHHAHDAYLNAVVGTALIKKYPKLESEFVYGDYKVYDVRKMIAKS</u>

<u>EQEIGKATAKYFFYSNIMNFFKTEITLANGEIRKRPLIETNGETGEIVWDKGRDFATVRKVLSM</u>

<u>PQVNIVKKTEVQT</u>GGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTIDRKRYTSTKEVLDA

TLIHQSITGLYETRIDLSQLGGD (single underline: HNH domain; double underline: RuvC domain)

In some embodiments, wild-type Cas9 corresponds to, or comprises the following nucleotide and/or amino acid sequences:

(SEQ ID NO: 30)
ATGGATAAAAAGTATTCTATTGGTTTAGACATCGGCACTAATTCCGTTGGATGGGCTGTCATAA

CCGATGAATACAAAGTACCTTCAAAGAAATTTAAGGTGTTGGGGAACACAGACCGTCATTCGAT

TAAAAAGAATCTTATCGGTGCCCTCCTATTCGATAGTGGCGAAACGGCAGAGGCGACTCGCCTG

AAACGAACCGCTCGGAGAAGGTATACACGTCGCAAGAACCGAATATGTTACTTACAAGAAATTT

TTAGCAATGAGATGGCCAAAGTTGACGATTCTTTCTTTCACCGTTTGGAAGAGTCCTTCCTTGT

CGAAGAGGACAAGAAACATGAACGGCACCCCATCTTTGGAAACATAGTAGATGAGGTGGCATAT

CATGAAAAGTACCCAACGATTTATCACCTCAGAAAAAGCTAGTTGACTCAACTGATAAAGCGG

ACCTGAGGTTAATCTACTTGGCTCTTGCCCATATGATAAAGTTCCGTGGGCACTTTCTCATTGA

GGGTGATCTAAATCCGGACAACTCGGATGTCGACAAACTGTTCATCCAGTTAGTACAAACCTAT

AATCAGTTGTTTGAAGAGAACCCTATAAATGCAAGTGGCGTGGATGCGAAGGCTATTCTTAGCG

CCCGCCTCTCTAAATCCCGACGGCTAGAAAACCTGATCGCACAATTACCCGGAGAGAAGAAAA

TGGGTTGTTCGGTAACCTTATAGCGCTCTCACTAGGCCTGACACCAAATTTTAAGTCGAACTTC

GACTTAGCTGAAGATGCCAAATTGCAGCTTAGTAAGGACACGTACGATGACGATCTCGACAATC

TACTGGCACAAATTGGAGATCAGTATGCGGACTTATTTTTGGCTGCCAAAAACCTTAGCGATGC

AATCCTCCTATCTGACATACTGAGAGTTAATACTGAGATTACCAAGGCGCCGTTATCCGCTTCA

ATGATCAAAAGGTACGATGAACATCACCAAGACTTGACACTTCTCAAGGCCCTAGTCCGTCAGC

AACTGCCTGAGAAATATAAGGAAATATTCTTTGATCAGTCGAAAAACGGGTACGCAGGTTATAT

TGACGGCGGAGCGAGTCAAGAGGAATTCTACAAGTTTATCAAACCCATATTAGAGAAGATGGAT

GGGACGAAGAGTTGCTTGTAAAACTCAATCGCGAAGATCTACTGCGAAAGCAGCGGACTTTCG

ACAACGGTAGCATTCCACATCAAATCCACTTAGGCGAATTGCATGCTATACTTAGAAGGCAGGA

GGATTTTTATCCGTTCCTCAAAGACAATCGTGAAAAGATTGAGAAAATCCTAACCTTTCGCATA

CCTTACTATGTGGGACCCCTGGCCCGAGGGAACTCTCGGTTCGCATGGATGACAAGAAAGTCCG

AAGAAACGATTACTCCATGGAATTTTGAGGAAGTTGTCGATAAAGGTGCGTCAGCTCAATCGTT

CATCGAGAGGATGACCAACTTTGACAAGAATTTACCGAACGAAAAAGTATTGCCTAAGCACAGT

TTACTTTACGAGTATTTCACAGTGTACAATGAACTCACGAAAGTTAAGTATGTCACTGAGGGCA

TGCGTAAACCCGCCTTTCTAAGCGGAGAACAGAAGAAAGCAATAGTAGATCTGTTATTCAAGAC

CAACCGCAAAGTGACAGTTAAGCAATTGAAAGAGGACTACTTTAAGAAAATTGAATGCTTCGAT

TCTGTCGAGATCTCCGGGGTAGAAGATCGATTTAATGCGTCACTTGGTACGTATCATGACCTCC

TAAAGATAATTAAAGATAAGGACTTCCTGGATAACGAAGAGAATGAAGATATCTTAGAAGATAT

AGTGTTGACTCTTACCCTCTTTGAAGATCGGGAAATGATTGAGGAAAGACTAAAAACATACGCT

CACCTGTTCGACGATAAGGTTATGAAACAGTTAAAGAGGCGTCGCTATACGGGCTGGGGACGAT

TGTCGCGGAAACTTATCAACGGGATAAGAGACAAGCAAAGTGGTAAAACTATTCTCGATTTTCT

AAAGAGCGACGGCTTCGCCAATAGGAACTTTATGCAGCTGATCCATGATGACTCTTTAACCTTC

AAAGAGGATATACAAAAGGCACAGGTTTCCGGACAAGGGGACTCATTGCACGAACATATTGCGA

ATCTTGCTGGTTCGCCAGCCATCAAAAAGGGCATACTCCAGACAGTCAAAGTAGTGGATGAGCT

AGTTAAGGTCATGGGACGTCACAAACCGGAAAACATTGTAATCGAGATGGCACGCGAAAATCAA

ACGACTCAGAAGGGGCAAAAAAACAGTCGAGAGCGGATGAAGAGAATAGAAGAGGGTATTAAAG

AACTGGGCAGCCAGATCTTAAAGGAGCATCCTGTGGAAAATACCCAATTGCAGAACGAGAAACT

-continued

```
TTACCTCTATTACCTACAAAATGGAAGGGACATGTATGTTGATCAGGAACTGGACATAAACCGT

TTATCTGATTACGACGTCGATCACATTGTACCCCAATCCTTTTTGAAGGACGATTCAATCGACA

ATAAAGTGCTTACACGCTCGGATAAGAACCGAGGGAAAAGTGACAATGTTCCAAGCGAGGAAGT

CGTAAAGAAAATGAAGAACTATTGGCGGCAGCTCCTAAATGCGAAACTGATAACGCAAAGAAAG

TTCGATAACTTAACTAAAGCTGAGAGGGGTGGCTTGTCTGAACTTGACAAGGCCGGATTTATTA

AACGTCAGCTCGTGGAAACCCGCCAAATCACAAAGCATGTTGCACAGATACTAGATTCCCGAAT

GAATACGAAATACGACGAGAACGATAAGCTGATTCGGGAAGTCAAAGTAATCACTTTAAAGTCA

AAATTGGTGTCGGACTTCAGAAAGGATTTTCAATTCTATAAAGTTAGGGAGATAAATAACTACC

ACCATGCGCACGACGCTTATCTTAATGCCGTCGTAGGGACCGCACTCATTAAGAAATACCCGAA

GCTAGAAAGTGAGTTTGTGTATGGTGATTACAAAGTTTATGACGTCCGTAAGATGATCGCGAAA

AGCGAACAGGAGATAGGCAAGGCTACAGCCAAATACTTCTTTTATTCTAACATTATGAATTTCT

TTAAGCGGAAATCACTCTGGCAAACGGAGAGATACGCAAACGACCTTTAATTGAAACCAATGG

GGAGACAGGTGAAATCGTATGGGATAAGGGCCGGGACTTCGCGACGGTGAGAAAAGTTTTGTCC

ATGCCCCAAGTCAACATAGTAAAGAAAACTGAGGTGCAGACCGGAGGGTTTTCAAAGGAATCGA

TTCTTCCAAAAAGGAATAGTGATAAGCTCATCGCTCGTAAAAAGGACTGGGACCCGAAAAAGTA

CGGTGGCTTCGATAGCCCTACAGTTGCCTATTCTGTCCTAGTAGTGGCAAAAGTTGAGAAGGGA

AAATCCAAGAAACTGAAGTCAGTCAAAGAATTATTGGGGATAACGATTATGGAGCGCTCGTCTT

TTGAAAAGAACCCCATCGACTTCCTTGAGGCGAAAGGTTACAAGGAAGTAAAAAAGGATCTCAT

AATTAAACTACCAAAGTATAGTCTGTTTGAGTTAGAAAATGGCCGAAAACGGATGTTGGCTAGC

GCCGGAGAGCTTCAAAAGGGGAACGAACTCGCACTACCGTCTAAATACGTGAATTTCCTGTATT

TAGCGTCCCATTACGAGAAGTTGAAAGGTTCACCTGAAGATAACGAACAGAAGCAACTTTTTGT

TGAGCAGCACAAACATTATCTCGACGAAATCATAGAGCAAATTTCGGAATTCAGTAAGAGAGTC

ATCCTAGCTGATGCCAATCTGGACAAAGTATTAAGCGCATACAACAAGCACAGGGATAAACCCA

TACGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAGAC

GCGACACTGATTCACCAATCCATCACGGGATTATATGAAACTCGGATAGATTTGTCACAGCTTG

GGGGTGACGGATCCCCCAAGAAGAAGAGGAAAGTCTCGAGCGACTACAAAGACCATGACGGTGA

TTATAAAGATCATGACATCGATTACAAGGATGACGATGACAAGGCTGCAGGA
```

(SEQ ID NO: 31)
MDKK<u>YSIGLAIGTNSVGWAVITDEYKVPSKKFKVLGNTDRHSIKKNLIGALLFDSGETA</u>EATRL
KRTARRRYTRRKNRICYLQEIFSNEMAKVDDSFFHRLEESFLVEEDKKHERHPIFGNIVDEAY
HEKYPTIYHLRKKLVDSTDKADLRLIYLALAHMIKFRGHFLIEGDLNPDNSDVDKLFIQLVQTY
NQLFEENPINASGVDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILRVNTEITKAPLSAS
MIKRYDEHHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKILTFRI
PYYVGPLARGNSRFAWMTRKSEETITPWNFEEVVDKGASAQSFIERMTNFDKNLPNEKVLPKHS
LLYEYFTVYNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERLKTYA
HLFDDKVMKQLKRRRYTGWGRLSRKLINGIRDKQSGKTILDFLKSDGFANRNFMQLIHDDSLTF
KEDIQKAQVSGQG<u>DSLHEHIANLAGSPAIKKGILQTVKVVDELVKVMGRHKPENIVIEMARENQ</u>

-continued

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain)

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows):

(SEQ ID NO: 32)
ATGGATAAGAAATACTCAATAGGCTTAGATATCGGCACAAATAGCGTCGGATGGGCGGTGATCA

CTGATGAATATAAGGTTCCGTCTAAAAAGTTCAAGGTTCTGGGAAATACAGACCGCCACAGTAT

CAAAAAAAATCTTATAGGGGCTCTTTTATTTGACAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAATTGGTAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAACCTAC

AATCAATTATTTGAAGAAAACCCTATTAACGCAAGTGGAGTAGATGCTAAAGCGATTCTTTCTG

CACGATTGAGTAAATCAAGACGATTAGAAAATCTCATTGCTCAGCTCCCCGGTGAGAAGAAAA

TGGCTTATTTGGGAATCTCATTGCTTTGTCATTGGGTTTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATACTGAAATAACTAAGGCTCCCCTATCAGCTTCA

ATGATTAAACGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTTGCTGCGCAAGCAACGGACCTTTG

ACAACGGCTCTATTCCCCATCAAATTCACTTGGGTGAGCTGCATGCTATTTTGAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAAGTACTACCAAAACATAGT

-continued

```
TTGCTTTATGAGTATTTTACGGTTTATAACGAATTGACAAAGGTCAAATATGTTACTGAAGGAA
TGCGAAAACCAGCATTTCTTTCAGGTGAACAGAAGAAAGCCATTGTTGATTTACTCTTCAAAAC
AAATCGAAAAGTAACCGTTAAGCAATTAAAAGAAGATTATTTCAAAAAAATAGAATGTTTTGAT
AGTGTTGAAATTTCAGGAGTTGAAGATAGATTTAATGCTTCATTAGGTACCTACCATGATTTGC
TAAAAATTATTAAAGATAAAGATTTTTTGGATAATGAAGAAAATGAAGATATCTTAGAGGATAT
TGTTTTAACATTGACCTTATTTGAAGATAGGGAGATGATTGAGGAAAGACTTAAAACATATGCT
CACCTCTTTGATGATAAGGTGATGAAACAGCTTAAACGTCGCCGTTATACTGGTTGGGGACGTT
TGTCTCGAAAATTGATTAATGGTATTAGGGATAAGCAATCTGGCAAAACAATATTAGATTTTTT
GAAATCAGATGGTTTTGCCAATCGCAATTTTATGCAGCTGATCCATGATGATAGTTTGACATTT
AAAGAAGACATTCAAAAAGCACAAGTGTCTGGACAAGGCGATAGTTTACATGAACATATTGCAA
ATTTAGCTGGTAGCCCTGCTATTAAAAAAGGTATTTTACAGACTGTAAAAGTTGTTGATGAATT
GGTCAAAGTAATGGGGCGGCATAAGCCAGAAAATATCGTTATTGAAATGGCACGTGAAAATCAG
ACAACTCAAAAGGGCCAGAAAAATTCGCGAGAGCGTATGAAACGAATCGAAGAAGGTATCAAAG
AATTAGGAAGTCAGATTCTTAAAGAGCATCCTGTTGAAAATACTCAATTGCAAAATGAAAAGCT
CTATCTCTATTATCTCCAAAATGGAAGAGACATGTATGTGGACCAAGAATTAGATATTAATCGT
TTAAGTGATTATGATGTCGATCACATTGTTCCACAAAGTTTCCTTAAAGACGATTCAATAGACA
ATAAGGTCTTAACGCGTTCTGATAAAAATCGTGGTAAATCGGATAACGTTCCAAGTGAAGAAGT
AGTCAAAAAGATGAAAAACTATTGGAGACAACTTCTAAACGCCAAGTTAATCACTCAACGTAAG
TTTGATAATTTAACGAAAGCTGAACGTGGAGGTTTGAGTGAACTTGATAAAGCTGGTTTTATCA
AACGCCAATTGGTTGAAACTCGCCAAATCACTAAGCATGTGGCACAAATTTTGGATAGTCGCAT
GAATACTAAATACGATGAAAATGATAAACTTATTCGAGAGGTTAAAGTGATTACCTTAAAATCT
AAATTAGTTTCTGACTTCCGAAAAGATTTCCAATTCTATAAAGTACGTGAGATTAACAATTACC
ATCATGCCCATGATGCGTATCTAAATGCCGTCGTTGGAACTGCTTTGATTAAGAAATATCCAAA
ACTTGAATCGGAGTTTGTCTATGGTGATTATAAAGTTTATGATGTTCGTAAAATGATTGCTAAG
TCTGAGCAAGAAATAGGCAAAGCAACCGCAAAATATTTCTTTTACTCTAATATCATGAACTTCT
TCAAAACAGAAATTACACTTGCAAATGGAGAGATTCGCAAACGCCCTCTAATCGAAACTAATGG
GGAAACTGGAGAAATTGTCTGGGATAAAGGGCGAGATTTTGCCACAGTGCGCAAAGTATTGTCC
ATGCCCCAAGTCAATATTGTCAAGAAAACAGAAGTACAGACAGGCGGATTCTCCAAGGAGTCAA
TTTTACCAAAAGAAATTCGGACAAGCTTATTGCTCGTAAAAAAGACTGGGATCCAAAAAAATA
TGGTGGTTTTGATAGTCCAACGGTAGCTTATTCAGTCCTAGTGGTTGCTAAGGTGGAAAAAGGG
AAATCGAAGAAGTTAAAATCCGTTAAAGAGTTACTAGGGATCACAATTATGGAAAGAAGTTCCT
TTGAAAAAAATCCGATTGACTTTTTAGAAGCTAAAGGATATAAGGAAGTTAAAAAAGACTTAAT
CATTAAACTACCTAAATATAGTCTTTTTGAGTTAGAAAACGGTCGTAAACGGATGCTGGCTAGT
GCCGGAGAATTACAAAAAGGAAATGAGCTGGCTCTGCCAAGCAAATATGTGAATTTTTTATATT
TAGCTAGTCATTATGAAAAGTTGAAGGGTAGTCCAGAAGATAACGAACAAAAACAATTGTTTGT
GGAGCAGCATAAGCATTATTTAGATGAGATTATTGAGCAAATCAGTGAATTTTCTAAGCGTGTT
ATTTTAGCAGATGCCAATTTAGATAAAGTTCTTAGTGCATATAACAAACATAGAGACAAACCAA
TACGTGAACAAGCAGAAAATATTATTCATTTATTTACGTTGACGAATCTTGGAGCTCCCGCTGC
TTTTAAATATTTTGATACAACAATTGATCGTAAACGATATACGTCTACAAAAGAAGTTTTAGAT
GCCACTCTTATCCATCAATCCATCACTGGTCTTTATGAAACACGCATTGATTTGAGTCAGCTAG
```

-continued

```
GAGGTGACTGA

MDKKYSIGLDIGINSVGWAVITDEYKVPSKKFKVLGNIDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKINRKVIVKQLKEDYFKKIECFD

SVEISGVEDRFNASLGTYHDLLKIIKDKDFLDNEENEDILEDIVLILTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQG
DSLHEHIANLAGSPAIKKGILQTVKVVDELVKVMGRHKPENIVIEMARENQRENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQIIKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (SEQ ID NO: 1. single underline: HNH
domain; double underline: RuvC domain).
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria meningitidis* (NCBI Ref: YP_002342100.1) or to a Cas9 from any other organism.

In some embodiments, the Cas9 is a *Neisseria menigitidis* Cas9 (NmeCas9) or a variant thereof. In some embodiments, the NmeCas9 has specificity for a NNNNGAYW PAM, wherein Y is C or T and W is A or T. In some embodiments, the NmeCas9 has specificity for a NNNNGYTT PAM, wherein Y is C or T. In some embodiments, the NmeCas9 has specificity for a NNNNGTCT PAM. In some embodiments, the NmeCas9 is a Nme1 Cas9. In some embodiments, the NmeCas9 has specificity for a NNNNGATT PAM, a NNNNCCTA PAM, a NNNNCCTC PAM, a NNNNCCTT PAM, a NNNNCCTG PAM, a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the Nme1 Cas9 has specificity for a NNNNGATT PAM, a NNNNCCTA PAM, a NNNNCCTC PAM, a NNNNCCTT PAM, or a NNNNCCTG PAM. In some embodiments, the NmeCas9 has specificity for a CAA PAM, a CAAA PAM, or a CCA PAM. In some embodiments, the NmeCas9 is a Nme2 Cas9. In some embodiments, the NmeCas9 has specificity for a NNNNCC (N4CC) PAM, wherein N is any one of A, G, C, or T. in some embodiments, the NmeCas9 has specificity for a NNNNCCGT PAM, a NNNNCCGGPAM, a NNNNCCCA PAM, a NNNNCCCT PAM, a NNNNCCCC PAM, a NNNNCCAT PAM, a NNNNCCAG PAM, a NNNNCCAT PAM, or a NNNGATT PAM. In some embodiments, the NmeCas9 is a Nme3Cas9. In some embodiments, the NmeCas9 has specificity for a NNNNCAAA PAM, a NNNNCC PAM, or a NNNNCNNN PAM. In some embodiments, the PAM-interacting domains for Nme1, Nme2 or Nme3 are $N_4GAT$, $N_4CC$, and $N_4CAAA$, respectively. Additional NmeCas9 features and PAM sequences are described in Edraki et al., A Compact, High-Accuracy Cas9 with a Dinucleotide PAM for In Vivo Genome Editing, *Mol. Cell.* (2019) 73(4): 714-726, which is incorporated herein by reference in its entirety.

An exemplary *Neisseria meningitidis* Cas9 protein, Nme1 Cas9, (NCBI Reference: WP_002235162.1; type II CRISPR RNA-guided endonuclease Cas9) has the following amino acid sequence:

```
                                                                  (SEQ ID NO: 33)
   1  maafkpnpin yilgldigia svgwamveid edenpiclid lgvrvferae vpktgdslam 61  arrlarsvrr ltrrrahrll rarrllkreg vlqaadfden glikslpntp wqlraaaldr 121  kltplewsav llhlikhrgy lsqrkneget adkelgallk gvadnahalq tgdfrtpael 181  alnkfekesg hirnqrgdys htfsrkdlqa elillfekqk efgnphvsgg lkegietllm 241  tqrpalsgda vqkmlghctf epaepkaakn tytaerfiwl tklnnlrile qgserpltdt 301  eratlmdepy rkskltyaqa rkllgledta ffkglrygkd naeastlmem kayhaisral 361  ekeglkdkks pinlspelqd eigtafslfk tdeditgrlk driqpeilea llkhisfdkf 421  vqislkalrr ivplmeqgkr ydeacaeiyg dhygkkntee kiylppipad eirnpvvlra 481  lsqarkving vvrrygspar ihietarevg ksfkdrkeie krqeenrkdr ekaaakfrey 541  fpnfvgepks kdilklrlye qqhgkclysg keinlgrine kgyveidhal pfsrtwddsf 601  nnkvlvlgse nqnkgnqtpy eyfngkdnsr ewqefkarve tsrfprskkq rillqkfded 661  gfkernlndt ryvnrflcqf vadrmrltgk gkkrvfasng qitnllrgfw glrkvraend 721  rhhaldavvv acstvamqqk itrfvrykem nafdgktidk etgevlhqkt hfpqpweffa 781  qevmirvfgk pdgkpefeea dtpeklrtll aeklssrpea vheyvtplfv srapnrkmsg 841  qghmetvksa krldegvsvl rvpltqlklk dlekmvnrer epklyealka rleahkddpa 901  kafaepfyky dkagnrtqqv kavrveqvqk tgvwvrnhng iadnatmvrv dvfekgdkyy 961  lvpiyswqva kgilpdravv qgkdeedwql iddsfnfkfs lhpndlvevi tkkarmfgyf 1021  aschrgtgni nirihdldhk igkngilegi gvktalsfqk yqidelgkei rpcrlkkrpp 1081  vr
```

Another exemplary *Neisseria meningitidis* Cas9 protein, Nme2Cas9, (NCBI Reference: WP_002230835; type II CRISPR RNA-guided endonuclease Cas9) has the following amino acid sequence:

```
                                                                  (SEQ ID NO: 34)
   1  maafkpnpin yilgldigia svgwamveid eeenpirlid lgvrvferae vpktgdslam 61  arrlarsvrr ltrrrahrll rarrllkreg vlqaadfden glikslpntp wqlraaaldr 121  kltplewsav llhlikhrgy lsqrkneget adkelgallk gvannahalq tgdfrtpael 181  alnkfekesg hirnqrgdys htfsrkdlqa elillfekqk efgnphvsgg lkegietllm 241  tqrpalsgda vqkmlghctf epaepkaakn tytaerfiwl tklnnlrile qgserpltdt 301  eratlmdepy rkskltyaqa rkllgledta ffkglrygkd naeastlmem kayhaisral 361  ekeglkdkks pinlsselqd eigtafslfk tdeditgrlk drvqpeilea llkhisfdkf 421  vqislkalrr ivplmeqgkr ydeacaeiyg dhygkkntee kiylppipad eirnpvvlra 481  lsqarkving vvrrygspar ihietarevg ksfkdrkeie krqeenrkdr ekaaakfrey 541  fpnfvgepks kdilklrlye qqhgkclysg keinlvrine kgyveidhal pfsrtwddsf 601  nnkvlvlgse nqnkgnqtpy eyfngkdnsr ewqefkarve tsrfprskkq rillqkfded 661  gfkecnlndt ryvnrflcqf vadhilltgk gkrrvfasng qitnllrgfw glrkvraend 721  rhhaldavvv acstvamqqk itrfvrykem nafdgktidk etgkvlhqkt hfpqpweffa 781  qevmirvfgk pdgkpefeea dtpeklrtll aeklssrpea vheyvtplfv srapnrkmsg
```

```
 841  ahkdtlrsak rfvkhnekis vkrvwlteik ladlenmvny kngreielye alkarleayg 901  gnakqafdpk dnpfykkggq lvkavrvekt qesgvllnkk naytiadngd mvrvdvfckv 961  dkkgknqyfi vpiyawqvae nilpdidckg yriddsytfc fslhkydlia fqkdekskve 1021  fayyincdss ngrfylawhd kgskeqqfri stqnlvliqk yqvnelgkei rpcrlkkrpp 1081  vr
```

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9. In some embodiments, the dCas9 comprises the amino acid sequence of dCas9 (D10A and H840A):

D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identi- (SEQ ID NO: 35)
MDKK<u>YSIGLAIGTNSVGWAVITDEYKVPSKKFKVLGNTDRHSIKKNLIGALLFDSGETA</u>EATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKINRKVIVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQG<u><u>DSLHEHIANLAGSPAIKKGILQTVKVVDELVKVMGRHKPENIVIEMA</u></u>RENQ

TTQK<u><u>GQKNSRERMKRIEEGIKELGSQILKEHPVENTQLQNEKLYLYYLQNGRDMYVDQELDINR</u></u>

<u><u>LSDYDVDAIVPQSFLKDDSIDNKVLTRSDKNRGKSDNVPSEEVVKKMKNYWRQLLNAKLITQRK</u></u>

<u><u>FDNLTKAERGGL</u></u>SELDKAGFIKRQLVETRQIIKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENITHLFTLTNLGAPAAFKYFDTTIDRKRYTSTKEVLD

ATLIHQSITGLYETRIDLSQLGGD (single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at cal. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

Exemplary Catalytically Inactive Cas9 (dCas9):

(SEQ ID NO: 36)
DKKYSIGLAIGTNSVGWAVITDEYKVPSKKFKVLGNTDRHSIKKNLIGALL
FDSGETAEATRLKRTARRRYTRRKNRICYLQEIFSNEMAKVDDSFFHRLEE
SFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASG
VDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILR
VNTEITKAPLSASMIKRYDEHHQDLTLLKALVRQQLPEKYKEIFFDQSKNG
YAGYIDGGASQEEFYKFIKPILEKMDGTEELLVKLNREDLLRKQRTFDNGS
IPHQIHLGELHAILRRQEDFYPFLKDNREKIEKILTFRIPYYVGPLARGNS
RFAWMTRKSEETITPWNFEEVVDKGASAQSFIERMTNFDKNLPNEKVLPKH
SLLYEYFTVYNELTKVKYVTEGMRKPAFLSGEQKKAIVDLLFKTNRKVTVK
QLKEDYFKKIECFDSVEISGVEDRFNASLGTYHDLLKIIKDKDFLDNEENE
DILEDIVLTLTLFEDREMIEERLKTYAHLFDDKVMKQLKRRRYTGWGRLSR
KLINGIRDKQSGKTILDFLKSDGFANRNFMQLIHDDSLTFKEDIQKAQVSG
QGDSLHEHIANLAGSPAIKKGILQTVKVVDELVKVMGRHKPENIVIEMARE
NQTTQKGQKNSRERMKRIEEGIKELGSQILKEHPVENTQLQNEKLYLYYLQ
NGRDMYVDQELDINRLSDYDVDAIVPQSFLKDDSIDNKVLTRSDKNRGKSD
NVPSEEVVKKMKNYWRQLLNAKLITQRKFDNLTKAERGGLSELDKAGFIKR
QLVETRQITKHVAQILDSRMNTKYDENDKLIREVKVITLKSKLVSDFRKDF
QFYKVREINNYHHAHDAYLNAVVGTALIKKYPKLESEFVYGDYKVYDVRKM
IAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARK
KDWDPKKYGGFDSPTVAYSVLVVAKVEKGKSKKLKSVKELLGITIMERSSF
EKNPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQISEF
SKRVILADANLDKVLSAYNKHRDKPIREQAENIIHLFTLTNLGAPAAFKYF
DTTIDRKRYTSTKEVLDATLIHQSITGLYETRIDLSQLGGD

Exemplary Catalytically Cas9 Nickase (nCas9):

(SEQ ID NO: 37)
DKKYSIGLAIGTNSVGWAVITDEYKVPSKKFKVLGNTDRHSIKKNLIGALL
FDSGETAEATRLKRTARRRYTRRKNRICYLQEIFSNEMAKVDDSFFHRLEE
SFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASG
VDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILR
VNTEITKAPLSASMIKRYDEHHQDLTLLKALVRQQLPEKYKEIFFDQSKNG
YAGYIDGGASQEEFYKFIKPILEKMDGTEELLVKLNREDLLRKQRTFDNGS
IPHQIHLGELHAILRRQEDFYPFLKDNREKIEKILTFRIPYYVGPLARGNS
RFAWMTRKSEETITPWNFEEVVDKGASAQSFIERMTNFDKNLPNEKVLPKH
SLLYEYFTVYNELTKVKYVTEGMRKPAFLSGEQKKAIVDLLFKTNRKVTVK
QLKEDYFKKIECFDSVEISGVEDRFNASLGTYHDLLKIIKDKDFLDNEENE
DILEDIVLTLTLFEDREMIEERLKTYAHLFDDKVMKQLKRRRYTGWGRLSR
KLINGIRDKQSGKTILDFLKSDGFANRNFMQLIHDDSLTFKEDIQKAQVSG
QGDSLHEHIANLAGSPAIKKGILQTVKVVDELVKVMGRHKPENIVIEMARE
NQTTQKGQKNSRERMKRIEEGIKELGSQILKEHPVENTQLQNEKLYLYYLQ
NGRDMYVDQELDINRLSDYDVDHIVPQSFLKDDSIDNKVLTRSDKNRGKSD
NVPSEEVVKKMKNYWRQLLNAKLITQRKFDNLTKAERGGLSELDKAGFIKR
QLVETRQITKHVAQILDSRMNTKYDENDKLIREVKVITLKSKLVSDFRKDF
QFYKVREINNYHHAHDAYLNAVVGTALIKKYPKLESEFVYGDYKVYDVRKM
IAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARK
KDWDPKKYGGFDSPTVAYSVLVVAKVEKGKSKKLKSVKELLGITIMERSSF
EKNPIDFLEAKGYKEVKKDLIIKLPKYSLFELENGRKRMLASAGELQKGNE
LALPSKYVNFLYLASHYEKLKGSPEDNEQKQLFVEQHKHYLDEIIEQISEF
SKRVILADANLDKVLSAYNKHRDKPIREQAENIIHLFTLTNLGAPAAFKYF
DTTIDRKRYTSTKEVLDATLIHQSITGLYETRIDLSQLGGD

Exemplary Catalytically Active Cas9:

(SEQ ID NO: 38)
DKKYSIGLDIGTNSVGWAVITDEYKVPSKKFKVLGNTDRHSIKKNLIGALL
FDSGETAEATRLKRTARRRYTRRKNRICYLQEIFSNEMAKVDDSFFHRLEE
SFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASG
VDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILR
VNTEITKAPLSASMIKRYDEHHQDLTLLKALVRQQLPEKYKEIFFDQSKNG
YAGYIDGGASQEEFYKFIKPILEKMDGTEELLVKLNREDLLRKQRTFDNGS
IPHQIHLGELHAILRRQEDFYPFLKDNREKIEKILTFRIPYYVGPLARGNS
RFAWMTRKSEETITPWNFEEVVDKGASAQSFIERMTNFDKNLPNEKVLPKH

-continued

```
SLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENE

DILEDIVLTLTLFEDREMIEERLKTYAHLFDDKVMKQLKRRRYTGWGRLSR

KLINGIRDKQSGKTILDFLKSDGFANRNFMQLIHDDSLTFKEDIQKAQVSG

QGDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARK

KDWDPKKYGGFDSPTVAYSVLVVAKVEKGKSKKLKSVKELLGITIMERSSF

EKNPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKYF

DTTIDRKRYTSTKEVLDATLIHQSITGLYETRIDLSQLGGD.
```

In some embodiments, Cas9 refers to a Cas9 from archaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp) and are within the scope of this disclosure.

In some embodiments, the Cas9 is a Cas9 variant having specificity for an altered PAM sequence. In some embodiments, the Additional Cas9 variants and PAM sequences are described in Miller et al., Continuous evolution of SpCas9 variants compatible with non-G PAMs. Nat Biotechnol (2020), doi.org/10.1038/s41587-020-0412-8, the entirety of which is incorporated herein by reference. In some embodiments, a Cas9 variant has no specific PAM requirements. In some embodiments, a Cas9 variant, e.g., a SpCas9 variant has specificity for a NRNH PAM, wherein R is A or G and H is A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 as numbered relative to the below reference sequence, or a corresponding position thereof.

(SEQ ID NO: 1)
```
MDKKYSIGLDIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDN

SDVDKLFIQLVQTYNQLFEENPINASGVDAKAILSARLSKSRRLENLIAQLPGEKKNGLF

GNLIALSLGLTPNFKSNFDLAEDAKLQLSKDTYDDDLDNLLAQIGDQYADLFLAAKNLS

DAILLSDILRVNTEITKAPLSASMIKRYDEHHQDLTLLKALVRQQLPEKYKEIFFDQSKN

GYAGYIDGGASQEEFYKFIKPILEKMDGTEELLVKLNREDLLRKQRTFDNGSIPHQIHLG

ELHAILRRQEDFYPFLKDNREKIEKILTFRIPYYVGPLARGNSRFAWMTRKSEETITPWN

FEEVVDKGASAQSFIERMTNFDKNLPNEKVLPKHSLLYEYFTVYNELTKVKYVTEGMR

KPAFLSGEQKKAIVDLLFKTNRKVTVKQLKEDYFKKIECFDSVEISGVEDRFNASLGTY

HDLLKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKAQV

SGQGDSLHEHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMYVDQELDI

NRLSDYDVDHIVPQSFLKDDSIDNKVLTRSDKNRGKSDNVPSEEVVKKMKNYWRQLL

NAKLITQRKFDNLTKAERGGLSELDKAGFIKRQLVETRQITKHVAQILDSRMNTKYDEN

DKLIREVKVITLKSKLVSDFRKDFQFYKVREINNYHHAHDAYLNAVVGTALIKKYPKLE

SEFVYGDYKVYDVRKMIAKSEQEIGKATAKYFFYSNIMNFFKTEITLANGEIRKRPLIET
```

-continued

NGETGEIVWDKGRDFATVRKVLSMPQVNIVKKTEVQTGGFSKESILPKRNSDKLIARKK

DWDPKKYGGFDSPTVAYSVLVVAKVEKGKSKKLKSVKELLGITIMERSSFEKNPIDFLE

AKGYKEVKKDLIIKLPKYSLFELENGRKRMLASAGELQKGNELALPSKYVNFLYLASH

YEKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRIDL

SQLGGD (single underline: HNH domain; double underline: RuvC domain).

In some embodiments, the SpCas9 variant comprises an amino acid substitution at position 1114, 1135, 1218, 1219, 1221, 1249, 1320, 1321, 1323, 1332, 1333, 1335, or 1337 as numbered relative to the above reference sequence, or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 as numbered relative to the above reference sequence, or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 as numbered relative to the above reference sequence, or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 as numbered relative to the above reference sequence. Exemplary amino acid substitutions and PAM specificity of SpCas9 variants are shown in the below Tables A-D and FIG. 49.

TABLE A

| | SpCas9 amino acid position | | | | | | | | | | | | |
|---|---|---|---|---|---|---|---|---|---|---|---|---|---|
| SpCas9 | 1114 R | 1135 D | 1218 G | 1219 E | 1221 Q | 1249 P | 1320 A | 1321 P | 1323 A | 1332 D | 1333 R | 1335 R | 1337 T |
| AAA | | N | | V | H | | | | | | G | | |
| AAA | | N | | V | H | | | | | | G | | |
| AAA | | | | V | | | | | | | G | | |
| TAA | G | N | | V | | | | | | | I | | |
| TAA | | N | | V | | | | | | | I | | A |
| TAA | G | N | | V | | | | | | | I | | A |
| CAA | | | | V | | | | | | | K | | |
| CAA | | N | | V | | | | | | | K | | |
| CAA | | N | | V | | | | | | | K | | |
| GAA | | | | V | H | | V | | | | K | | |
| GAA | | N | | V | | | V | | | | K | | |
| GAA | | | | V | H | | V | | | | K | | |
| TAT | | | S | V | H | S | | S | | | | L | |
| TAT | | | S | V | H | S | | S | | | | L | |
| TAT | | | S | V | H | S | | S | | | | L | |
| GAT | | | | V | | | | | | | I | | |
| GAT | | | | V | | | | | D | | Q | | |
| GAT | | | | V | | | | | D | | Q | | |
| CAC | | | | V | | | | | | N | Q | | N |
| CAC | | N | | V | | | | | | | Q | | N |
| CAC | | | | V | | | | | | N | Q | | N |

TABLE B

| | SpCas9 amino acid position | | | | | | | | | | | | | | | | | | |
|---|---|---|---|---|---|---|---|---|---|---|---|---|---|---|---|---|---|---|---|
| SpCas9 | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
| GAA | | | | | | | | | | V | H | | | | | | V | | K |
| GAA | | | N | S | | | | | | V | | | | | | | V | D | K |
| GAA | | | N | | | | | | | V | H | Y | | | | | V | | K |
| CAA | | | N | | | | | | | V | H | Y | | | | | V | | K |
| CAA | G | | N | S | | | | | | V | H | Y | | | | | V | | K |
| CAA | | | N | | | | | R | | V | H | | | | | | V | | K |
| CAA | | | N | | | G | | | R | V | H | Y | | | | | V | | K |
| CAA | | | N | | | | | | | V | H | Y | | | | | V | | K |
| AAA | | | N | | | G | | | | V | H | R | Y | | | | V | D | K |
| CAA | G | | N | | | G | | | | V | H | | Y | | | | V | D | K |
| CAA | | L | N | | | G | | | | V | H | | Y | | T | | V | D | K |
| TAA | G | | N | | | G | | | | V | H | | Y | G | S | | V | D | K |
| TAA | G | | N | | E | G | | | | V | H | | Y | | S | | V | | K |

TABLE B-continued

| SpCas9 | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
|---|---|---|---|---|---|---|---|---|---|---|---|---|---|---|---|---|---|---|---|
| TAA | G |  | N |  |  |  | G |  |  | V | H |  | Y |  | S |  | V | D | K |
| TAA | G |  | N |  |  |  | G | R |  | V | H |  |  |  |  |  | V |  | K |
| TAA |  |  | N |  |  |  | G | R |  | V | H |  | Y |  |  |  | V |  | K |
| TAA | G |  | N |  | A |  | G |  |  | V | H |  |  |  |  |  | V |  | K |
| TAA | G |  | N |  |  |  |  |  |  | V | H |  |  |  |  |  | V |  | K |

TABLE C

| SpCas9 | 1114 R | 1131 Y | 1135 D | 1150 E | 1156 K | 1180 D | 1191 K | 1218 G | 1219 E | 1221 Q |
|---|---|---|---|---|---|---|---|---|---|---|
| SacB.TAT |  |  | N |  |  |  | N |  | V | H |
| SacB.TAT |  |  | N |  |  |  |  | S | V | H |
| AAT |  |  | N |  |  |  |  | S | V | H |
| TAT | G |  | N |  |  | G |  | S | V | H |
| TAT | G |  | N |  |  | G |  | S | V | H |
| TAT | G | C | N |  |  | G |  | S | V | H |
| TAT | G | C | N |  |  | G |  | S | V | H |
| TAT | G | C | N |  |  | G |  | S | V | H |
| TAT | G | C | N |  | E | G |  | S | V | H |
| TAT | G | C | N | V |  | G |  | S | V | H |
| TAT |  | C | N |  |  | G |  | S | V | H |
| TAT | G | C | N |  |  | G |  | S | V | H |

| SpCas9 | 1227 A | 1249 P | 1253 E | 1286 N | 1293 A | 1320 A | 1321 P | 1332 D | 1335 R | 1339 T |
|---|---|---|---|---|---|---|---|---|---|---|
| SacB.TAT |  |  |  |  |  | V | S |  | L |  |
| SacB.TAT |  | S |  |  |  |  | S | G | L |  |
| AAT | V | S |  | K | T |  | S | G | L | I |
| TAT |  | S | K |  |  |  | S | G | L |  |
| TAT |  | S |  |  |  |  | S | G | L |  |
| TAT |  | S |  |  |  |  | S | G | L |  |
| TAT |  | S |  |  |  |  | S | G | L |  |
| TAT |  | S |  |  |  |  | S | G | L |  |
| TAT |  | S |  |  |  |  | S | G | L |  |
| TAT |  | S |  |  |  |  | S | G | L |  |
| TAT |  | S |  |  |  |  | S | G | L |  |
| TAT |  | S |  |  |  |  | S | G | L |  |

TABLE D

| SpCas9 | 1114 R | 1127 D | 1135 D | 1180 D | 1207 E | 1219 E | 1234 N | 1286 N | 1301 P | 1332 D | 1335 R | 1337 T | 1338 S | 1349 H |
|---|---|---|---|---|---|---|---|---|---|---|---|---|---|---|
| SacB.CAC |  |  | N |  |  | V |  |  |  | N | Q | N |  |  |
| AAC | G |  | N |  |  | V |  |  |  | N | Q | N |  |  |
| AAC | G |  | N |  |  | V |  |  |  | N | Q | N |  |  |
| TAC | G |  | N |  |  | V |  |  |  | N | Q | N |  |  |
| TAC | G |  | N |  |  | V |  | H |  | N | Q | N |  |  |
| TAC | G |  | N |  | G | V | D | H |  | N | Q | N |  |  |
| TAC | G |  | N |  |  | V |  |  |  | N | Q | N |  |  |
| TAC | G | G | N | E |  | V |  | H |  | N | Q | N |  |  |
| TAC | G |  | N |  |  | V |  | H |  | N | Q | N |  |  |
| TAC | G |  | N |  |  | V |  |  |  | N | Q | N | T | R |

In particular embodiments, napDNAbps useful in the methods of the invention include circular permutants, which are known in the art and described, for example, by Oakes et al., Cell 176, 254-267, 2019. An exemplary circular permutant follows where the bold sequence indicates sequence derived from Cas9, the italics sequence denotes a linker sequence, and the underlined sequence denotes a bipartite nuclear localization sequence, CP5 (with MSP "NGC=Pam Variant with mutations Regular Cas9 likes NGG" PID=Protein Interacting Domain and "D10A" nickase):

(SEQ ID NO: 3)
EIGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDPK

KYGGFMQPTVAYSVLVVAKVEKGKSKKLKSVKELLGITIMERSSFEKNPID

FLEAKGYKEVKKDLIIKLPKYSLFELENGRKRMLASAKFLQKGNELALPSK

YVNFLYLASHYEKLKGSPEDNEQKQLFVEQHKHYLDEIIEQISEFSKRVIL

ADANLDKVLSAYNKHRDKPIREQAENIIHLFTLTNLGAPRAFKYFDTTIAR

KEYRSTKEVLDATLIHQSITGLYETRIDLSQLGGD*GSGGSGGSGGSGGSG*

*GSGGMDKKYSIGLA*IGTNSVGWAVITDEYKVPSKKFKVLGNTDRHSIKKNL

IGALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFFD

QSIMGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPL

ARGNSRFAWMTRKSEETITPWNFEEVVDKGASAQSFIERMTNFDKNLPNEK

VLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLD

NEENEDILEDIVLTLTLFEDREMIEERLKTYAHLFDDKVMKQLKRRRYTGW

GRLSRKLINGIRDKQSGKTILDFLKSDGFANRNFMQLIHDDSLTEYEDIQK

AQVSGQGDSLHEHIANLAGSPAIKKGILQTVKVVDELVKVMGRHKPENIVI

EMARENQTTQKGQKNSRERMKRIEEGIKELGSQILKEHPVENTQLQNEKLY

LYYLQNGRDMYVDQELDINRLSDYDVDHIVPQSFLKDDSIDNKVLTRSDKN

RGKSDNVPSEEVVKKMKNYWRQLLNAKLITQRKFDNLTKAERGGLSELDKA

GFIKRQLVETRQITKHVAQILDSRMNTKYDENDKLIREVKVITLKSKLVSD

FRKDFQFYKVREINNYHHAHDAYLNAVVGTALIKKYPKLESEFVYGDYKVY

DVRKMIAKSEQ*EGADKRTADGSEFESPKKKRKV*\*

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN).

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that Cas12b/C2c1, CasX and CasY from other bacterial species may also be used in accordance with the present disclosure.

Cas12b/C2c1 (uniprot.org/uniprot/T0D7A2#2)
sp|T0D7A2|C2C1_ALIAG CRISPR-associated endo-nuclease C2c1 OS = Alicyclobacillus acido-terrestris (strain ATCC 49025/DSM 3922/CIP 106132/ NCIMB 13137/GD3B) GN =c2c1 PE = 1 SV = 1

(SEQ ID NO: 39)
MAVKSIKVKLRLDDMPEIRAGLWKLHKEVNAGVRYYTEWLSLLRQENLYRRSPNGDGEQECDKTAEECKA

ELLERLRARQVENGHRGPAGSDDELLQLARQLYELLVPQAIGAKGDAQQIARKFLSPLADKDAVGGLGIA

KAGNKPRWVRMREAGEPGWEEEKEKAETRKSADRTADVLRALADFGLKPLMRVYTDSEMSSVEWKPLRKG

QAVRTWDRDMFQQAIERMMSWESWNQRVGQEYAKLVEQKNRFEQKNFVGQEHLVHLVNQLQQDMKEASPG

LESKEQTAHYVTGRALRGSDKVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGNLHQYTFLFNEFGERRHAIRF

HKLLKVENGVAREVDDVTVPISMSEQLDNLLPRDPNEPIALYFRDYGAEQHFTGEFGGAKIQCRRDQLAH

MHRRRGARDVYLNVSVRVQSQSEARGERRPPYAAVFRLVGDNHRAFVHFDKLSDYLAEHPDDGKLGSEGL

LSGLRVMSVDLGLRTSASISVFRVARKDELKPNSKGRVPFFFPIKGNDNLVAVHERSQLLKLPGETESKD

LRAIREERQRTLRQLRTQLAYLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAKDVVGGNSIEQIEYLERQYKF

LKSWSFFGKVSGQVIRAEKGSRFAITLREHIDHAKEDRLKKLADRIIMEALGYVYALDERGKGKWVAKYP

PCQLILLEELSEYQFNNDRPPSENNQLMQWSHRGVFQELINQAQVHDLLVGTMYAAFSSRFDARTGAPGI

RCRRVPARCTQEHNPEPFPWWLNKFVVEHTLDACPLRADDLIPTGEGEIFVSPFSAEEGDFHQIHADLNA

AQNLQQRLWSDFDISQIRLRCDWGEVDGELVLIPRLTGKRTADSYSNKVFYTNTGVTYYERERGKKRRKV

-continued

FAQEKLSEEEAELLVEADEAREKSVVLMRDPSGIINRGNWTRQKEFWSMVNQRIEGYLVKQIRSRVPLQ

DSACENTGDI

CasX (uniprot.org/uniprot/F0NN87; uniprot.org/uniprot/F0NH53)
>tr|F0NN87|F0NN87_SULIH CRISPR-associated Casx protein OS = *Sulfolobus
islandicus* (strain HVE10/4) GN = SiH_0402 PE = 4 SV = 1
(SEQ ID NO: 40)
MEVPLYNIFGDNYIIQVATEAENSTIYNNKVEIDDEELRNVLNLAYKIAKNNEDAAAERRGKAKKKKGEE

GETTTSNIILPLSGNDKNPWTETLKCYNFPTTVALSEVFKNFSQVKECEEVSAPSFVKPEFYEFGRSPGM

VERTRRVKLEVEPHYLIIAAAGWVLTRLGKAKVSEGDYVGVNVFTPTRGILYSLIQNVNGIVPGIKPETA

FGLWIARKVVSSVTNPNVSVVRIYTISDAVGQNPTTINGGFSIDLTKLLEKRYLLSERLEAIARNALSIS

SNMRERYIVLANYIYEYLTGSKRLEDLLYFANRDLIMNLNSDDGKVRDLKLISAYVNGELIRGEG

>tr|F0NH53|F0NH53_SULIR CRISPR associated protein, Casx OS = *Sulfolobus
islandicus* (strain REY15A) GN = SiRe_0771 PE = 4 SV = 1
(SEQ ID NO: 41)
MEVPLYNIFGDNYIIQVATEAENSTIYNNKVEIDDEELRNVLNLAYKIAKNNEDAAAERRGKAKKKKGEE

GETTTSNIILPLSGNDKNPWTETLKCYNFPTTVALSEVFKNFSQVKECEEVSAPSFVKPEFYKFGRSPGM

VERTRRVKLEVEPHYLIMAAAGWVLTRLGKAKVSEGDYVGVNVFTPTRGILYSLIQNVNGIVPGIKPETA

FGLWIARKVVSSVTNPNVSVVSIYTISDAVGQNPTTINGGFSIDLTKLLEKRDLLSERLEAIARNALSIS

SNMRERYIVLANYIYEYLTGSKRLEDLLYFANRDLIMNLNSDDGKVRDLKLISAYVNGELIRGEG

Deltaproteobacteria CasX
(SEQ ID NO: 42)
MEKRINKIRKKLSADNATKPVSRSGPMKTLLVRVMTDDLKKRLEKRRKKPEVMPQVISNNAANNLRMLLD

DYTKMKEAILQVYWQEFKDDHVGLMCKFAQPASKKIDQNKLKPEMDEKGNLTTAGFACSQCGQPLFVYKL

EQVSEKGKAYTNYFGRCNVAEHEKLILLAQLKPVKDSDEAVTYSLGKFGQRALDFYSIHVTKESTHPVKP

LAQIAGNRYASGPVGKALSDACMGTIASFLSKYQDIIIEHQKVVKGNQKRLESLRELAGKENLEYPSVTL

PPQPHTKEGVDAYNEVIARVRMWVNLNLWQKLKLSRDDAKPLLRLKGFPSFPVVERRENEVDWWNTINEV

KKLIDAKRDMGRVFWSGVTAEKRNTILEGYNYLPNENDHKKREGSLENPKKPAKRQFGDLLLYLEKKYAG

DWGKVFDEAWERIDKKIAGLTSHIEREEARNAEDAQSKAVLTDWLRAKASFVLERLKEMDEKEFYACEIQ

LQKWYGDLRGNPFAVEAENRVVDISGFSIGSDGHSIQYRNLLAWKYLENGKREFYLLMNYGKKGRIRFTD

GTDIKKSGKWQGLLYGGGKAKVIDLTFDPDDEQLIILPLAFGTRQGREFIWNDLLSLETGLIKLANGRVI

EKTIYNKKIGRDEPALFVALTFERREVVDPSNIKPVNLIGVARGENIPAVIALTDPEGCPLPEFKDSSGG

PTDILRIGEGYKEKQRAIQAAKEVEQRRAGGYSRKFASKSRNLADDMVRNSARDLFYHAVTHDAVLVFAN

LSRGFGRQGKRTFMTERQYTKMEDWLTAKLAYEGLTSKTYLSKTLAQYTSKTCSNCGFTITYADMDVMLV

RLKKTSDGWATTLNNKELKAEYQITYYNRYKRQTVEKELSAELDRLSEESGNNDISKWTKGRRDEALFLL

KKRFSHRPVQEQFVCLDCGHEVHAAEQAALNIARSWLFLNSNSTEFKSYKSGKQPFVGAWQAFYKRRLKE

VWKPNA

CasY (ncbi.nlm.nih.gov/protein/APG80656.1)
>APG80656.1 CRISPR-associated protein CasY [uncultured Parcubacteria group
bacterium]
(SEQ ID NO: 43)
MSKRHPRISGVKGYRLHAQRLEYTGKSGAMRTIKYPLYSSPSGGRTVPREIVSAINDDYVGLYGLSNFDD

LYNAEKRNEEKVYSVLDFWYDCVQYGAVFSYTAPGLLKNVAEVRGGSYELTKTLKGSHLYDELQIDKVIK

FLNKKEISRANGSLDKLKKDIIDCFKAEYRERHKDQCNKLADDIKNAKKDAGASLGERQKKLFRDFFGIS

EQSENDKPSFTNPLNLTCCLLPFDTVNNNRNRGEVLFNKLKEYAQKLDKNEGSLEMWEYIGIGNSGTAFS

NFLGEGFLGRLRENKITELKKAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVSSLLESIEKIVPDDSADDEKP

DIPAIAIYRRFLSDGRLTLNRFVQREDVQEALIKERLEAEKKKKPKKRKKKSDAEDEKETIDFKELFPHL

-continued

```
AKPLKLVPNFYGDSKRELYKKYKNAAIYTDALWKAVEKIYKSAFSSSLKNSFFDTDFDKDFFIKRLQKIF

SVYRRFNTDKWKPIVKNSFAPYCDIVSLAENEVLYKPKQSRSRKSAAIDKNRVRLPSTENIAKAGIALAR

ELSVAGFDWKDLLKKEEHEEYIDLIELHKTALALLLAVTETQLDISALDFVENGTVKDFMKTRDGNLVLE

GRFLEMFSQSIVFSELRGLAGLMSRKEFITRSAIQTMNGKQAELLYIPHEFQSAKITTPKEMSRAFLDLA

PAEFATSLEPESLSEKSLLKLKQMRYYPHYFGYELTRTGQGIDGGVAENALRLEKSPVKKREIKCKQYKT

LGRGQNKIVLYVRSSYYQTQFLEWFLHRPKNVQTDVAVSGSFLIDEKKVKTRWNYDALTVALEPVSGSER

VFVSQPFTIFPEKSAEEEGQRYLGIDIGEYGIAYTALEITGDSAKILDQNFISDPQLKTLREEVKGLKLD

QRRGTFAMPSTKIARIRESLVHSLRNRIHHLALKHKAKIVYELEVSRFEEGKQKIKKVYATLKKADVYSE

IDADKNLQTTVWGKLAVASEISASYTSQFCGACKKLWRAEMQVDETITTQELIGTVRVIKGGTLIDAIKD

FMRPPIFDENDTPFPKYRDFCDKHHISKKMRGNSCLFICPFCRANADADIQASQTIALLRYVKEEKKVED

YFERFRKLKNIKVLGQMKKI
```

20

The term "conservative amino acid substitution" or "conservative mutation" refers to the replacement of one amino acid by another amino acid with a common property. A functional way to define common properties between individual amino acids is to analyze the normalized frequencies of amino acid changes between corresponding proteins of homologous organisms (Schulz, G. E. and Schirmer, R. H., Principles of Protein Structure, Springer-Verlag, New York (1979)). According to such analyses, groups of amino acids can be defined where amino acids within a group exchange preferentially with each other, and therefore resemble each other most in their impact on the overall protein structure (Schulz, G. E. and Schirmer, R. H., supra). Non-limiting examples of conservative mutations include amino acid substitutions of amino acids, for example, lysine for arginine and vice versa such that a positive charge can be maintained; glutamic acid for aspartic acid and vice versa such that a negative charge can be maintained; serine for threonine such that a free —OH can be maintained; and glutamine for asparagine such that a free —NH$_2$ can be maintained.

The term "coding sequence" or "protein coding sequence" as used interchangeably herein refers to a segment of a polynucleotide that codes for a protein. The region or sequence is bounded nearer the 5' end by a start codon and nearer the 3' end with a stop codon. Coding sequences can also be referred to as open reading frames.

The term "deaminase" or "deaminase domain," as used herein, refers to a protein or enzyme that catalyzes a deamination reaction. In some embodiments, the deaminase is an adenosine deaminase, which catalyzes the hydrolytic deamination of adenine to hypoxanthine. In some embodiments, the deaminase is an adenosine deaminase, which catalyzes the hydrolytic deamination of adenosine or adenine (A) to inosine (I). In some embodiments, the deaminase or deaminase domain is an adenosine deaminase catalyzing the hydrolytic deamination of adenosine or deoxyadenosine to inosine or deoxyinosine, respectively. In some embodiments, the adenosine deaminase catalyzes the hydrolytic deamination of adenosine in deoxyribonucleic acid (DNA). The adenosine deaminases (e.g., engineered adenosine deaminases, evolved adenosine deaminases) provided herein can be from any organism, such as a bacterium. In some embodiments, the adenosine deaminase is from a bacterium, such as *Escherichia coli, Staphylococcus aureus, Salmonella typhimurium, Shewanella putrefaciens, Haemophilus influenzae*, or *Caulobacter crescentus*.

In some embodiments, the adenosine deaminase is a TadA deaminase. In some embodiments, the TadA deaminase is TadA variant. In some embodiments, the TadA variant is a TadA*8. In some embodiments, the deaminase or deaminase domain is a variant of a naturally occurring deaminase from an organism, such as a human, chimpanzee, gorilla, monkey, cow, dog, rat, or mouse. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 91%, at least 92%, at least 93%, at least 94%, at least 95%, at least 96%, at least 97%, at least 98%, at least 99%, at least 99.1%, at least 99.2%, at least 99.3%, at least 99.4%, at least 99.5%, at least 99.6%, at least 99.7%, at least 99.8%, or at least 99.9% identical to a naturally occurring deaminase. For example, deaminase domains are described in International PCT Application Nos. PCT/2017/045381 (WO 2018/027078) and PCT/US2016/058344 (WO 2017/070632), each of which is incorporated herein by reference for its entirety. Also, see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); Komor, A. C., et al., "Improved base excision repair inhibition and bacteriophage Mu Gam protein yields C:G-to-T:A base editors with higher efficiency and product purity" Science Advances 3:eaao4774 (2017)), and Rees, H. A., et al., "Base editing: precision chemistry on the genome and transcriptome of living cells." Nat Rev Genet. 2018 December; 19(12):770-788. doi: 10.1038/s41576-018-0059-1, the entire contents of which are hereby incorporated by reference.

"Detect" refers to identifying the presence, absence or amount of the analyte to be detected. In one embodiment, a sequence alteration in a polynucleotide or polypeptide is detected. In another embodiment, the presence of indels is detected.

By "detectable label" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "disease" is meant any condition or disorder that damages or interferes with the normal function of a cell, tissue, or organ. In an embodiment, the disease is SCD. In an embodiment, the disease is β-thallasemia.

The term "effective amount," as used herein, refers to an amount of a biologically active agent that is sufficient to elicit a desired biological response. The effective amount of active compound(s) used to practice the present invention for therapeutic treatment of a disease varies depending upon the manner of administration, the age, body weight, and general health of the subject. Ultimately, the attending physician or veterinarian will decide the appropriate amount and dosage regimen. Such amount is referred to as an "effective" amount. In particular embodiments, an effective amount is the amount of a base editor system of the invention (e.g., a fusion protein comprising a programmable DNA binding protein, a nucleobase editor and gRNA) that is sufficient to alter a SCD mutation in a cell to achieve a therapeutic effect (e.g., to reduce or control SCD in a subject or a symptom or condition thereof). Such therapeutic effect need not be sufficient to alter a SCD in all cells of a tissue or organ, but only in about 1%, 5%, 10%, 25%, 50%, 75% or more of the cells present in a tissue or organ. In one embodiment, an effective amount is sufficient to ameliorate one or more symptom of SCD, such symptoms include anemia and ischemia.

By "fragment" is meant a portion of a polypeptide or nucleic acid molecule. This portion contains, at least about 10%, 20%, 30%, 40%, 50%, 60%, 70%, 80%, or 90% of the entire length of the reference nucleic acid molecule or polypeptide. A fragment may contain 10, 20, 30, 40, 50, 60, 70, 80, 90, or 100, 200, 300, 400, 500, 600, 700, 800, 900, or 1000 nucleotides or amino acids.

By "guide RNA" or "gRNA" is meant a polynucleotide which can be specific for a target sequence and can form a complex with a polynucleotide programmable nucleotide binding domain protein (e.g., Cas9 or Cpf1). In an embodiment, the guide polynucleotide is a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA and comprises a stem-loop structure. For example, in some embodiments, domain (2) is identical or homologous to a tracrRNA as provided in Jinek et al., Science 337:816-821 (2012), the entire contents of which is incorporated herein by reference. Other examples of gRNAs (e.g., those including domain 2) can be found in U.S. Provisional Patent Application Ser. No. 61/874,682, filed Sep. 6, 2013, entitled "Switchable Cas9 Nucleases and Uses Thereof," and U.S. Provisional Patent Application Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." An extended gRNA will bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. As will be appreciated by those skilled in the art, RNA polynucleotide sequences, e.g., gRNA sequences, include the nucleobase uracil (U), a pyrimidine derivative, rather than the nucleobase thymine (T), which is included in DNA polynucleotide sequences. In RNA, uracil base-pairs with adenine and replaces thymine during DNA transcription.

"Hb G-Makassar" or "Makassar" refers to a human β-hemoglobin variant, the human Hemoglobin (Hb) of G-Makassar variant or mutation (HB Makassar variant), which is an asymptomatic, naturally-occurring variant (E6A) hemoglobin. Hb G-Makassar was first identified in Indonesia. (Mohamad, A. S. et al., 2018, Hematol. Rep., 10(3):7210 (doi: 10.4081/hr.2018.7210). The Hb G-Makassar mobility is slower when subjected to electrophoresis. The Makassar β-hemoglobin variant has its anatomical abnormality at the β-6 or A3 location where the glutamyl residue typically is replaced by an alanyl residue. The substitution of single amino acid in the gene encoding the β-globin subunit β-6 glutamyl to valine will result as sickle cell disease. Routine procedures, such as isoelectric focusing, hemoglobin electrophoresis separation by cation-exchange High Performance Liquid Chromatography (HPLC) and cellulose acetate electrophoresis, have been unable to separate the Hb G-Makassar and HbS globin forms, as they were found to have identical properties when analyzed by these methods. Consequently, Hb G-Makassar and HbS have been incorrectly identified and mistaken for each other by those skilled in the art, thus leading to misdiagnosis of Sickle Cell Disease (SCD).

"Hybridization" means hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

The term "inhibitor of base repair" or "IBR" refers to a protein that is capable in inhibiting the activity of a nucleic acid repair enzyme, for example a base excision repair (BER) enzyme. In some embodiments, the IBR is an inhibitor of inosine base excision repair. Exemplary inhibitors of base repair include inhibitors of APE1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG. In some embodiments, the base repair inhibitor is an inhibitor of Endo V or hAAG. In some embodiments, the base repair inhibitor is a catalytically inactive EndoV or a catalytically inactive hAAG.

In some embodiments, the base repair inhibitor is uracil glycosylase inhibitor (UGI). UGI refers to a protein that is capable of inhibiting a uracil-DNA glycosylase base-excision repair enzyme. In some embodiments, a UGI domain comprises a wild-type UGI or a fragment of a wild-type UGI. In some embodiments, the UGI proteins provided herein include fragments of UGI and proteins homologous to a UGI or a UGI fragment. In some embodiments, the base repair inhibitor is an inhibitor of inosine base excision repair. In some embodiments, the base repair inhibitor is a "catalytically inactive inosine specific nuclease" or "dead inosine specific nuclease. Without wishing to be bound by any particular theory, catalytically inactive inosine glycosylases (e.g., alkyl adenine glycosylase (AAG)) can bind inosine but cannot create an abasic site or remove the inosine, thereby sterically blocking the newly formed inosine moiety from DNA damage/repair mechanisms. In some embodiments, the catalytically inactive inosine specific nuclease can be capable of binding an inosine in a nucleic acid but does not cleave the nucleic acid. Non-limiting exemplary catalytically inactive inosine specific nucleases include catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation or a corresponding mutation in another AAG nuclease.

By "increases" is meant a positive alteration of at least 10%, 25%, 50%, 75%, or 100%.

An "intein" is a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Other intein systems may also be used. For example, a synthetic intein based on the dnaE intein, the Cfa-N (e.g., split intein-N) and Cfa-C (e.g., split intein-C) intein pair, has been described (e.g., in Stevens et al., J Am Chem Soc. 2016 Feb. 24; 138(7):2162-5, incorporated herein by reference). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference).

Exemplary nucleotide and amino acid sequences of inteins are provided.

DnaE Intein-N DNA:

(SEQ ID NO: 44)
TGCCTGTCATACGAAACCGAGATACTGACAGTAGAATATGGCCTTCTGC

CAATCGGGAAGATTGTGGAGAAACGGATAGAATGCACAGTTTACTCTGT

CGATAACAATGGTAACATTTATACTCAGCCAGTTGCCCAGTGGCACGAC

CGGGGAGAGCAGGAAGTATTCGAATACTGTCTGGAGGATGGAAGTCTCA

TTAGGGCCACTAAGGACCACAAATTTATGACAGTCGATGGCCAGATGCT

GCCTATAGACGAAATCTTTGAGCGAGAGTTGGACCTCATGCGAGTTGAC

AACCTTCCTAAT

DnaE Intein-N Protein:

(SEQ ID NO: 45)
CLSYETEILTVEYGLLPIGKIVEKRIECTVYSVDNNGNIYTQPVAQWHDR
GEQEVFEYCLEDGSLIRATKDHKFMTVDGQMLPIDEIFERELDLMRVDNL
PN

DnaE Intein-C DNA:

(SEQ ID NO: 46)
ATGATCAAGATAGCTACAAGGAAGTATCTTGGCAAACAAAACGTTTATGA
TATTGGAGTCGAAAGAGATCACAACTTTGCTCTGAAGAACGGATTCATAG
CTTCTAAT

Intein-C:

(SEQ ID NO: 47)
MIKIATRKYLGKQNVYDIGVERDHNFALKNGFIASN

Cfa-N DNA:

(SEQ ID NO: 48)
TGCCTGTCTTATGATACCGAGATACTTACCGTTGAATATGGCTTCTTGC

CTATTGGAAAGATTGTCGAAGAGAGAATTGAATGCACAGTATATACTGT

AGACAAGAATGGTTTCGTTTACACACAGCCCATTGCTCAATGGCACAAT

CGCGGCGAACAAGAAGTATTTGAGTACTGTCTCGAGGATGGAAGCATCA

TACGAGCAACTAAAGATCATAAATTCATGACCACTGACGGGCAGATGTT

GCCAATAGATGAGATATTCGAGCGGGCTTGGATCTCAAACAAGTGGAT

GGATTGCCA

Cfa-N Protein:

(SEQ ID NO: 49)
CLSYDTEILTVEYGFLPIGKIVEERIECTVYTVDKNGFVYTQPIAQWHNR

GEQEVFEYCLEDGSIIRATKDHKFMTTDGQMLPIDEIFERGLDLKQVDGL

P

Cfa-C DNA:

(SEQ ID NO: 50)
ATGAAGAGGACTGCCGATGGATCAGAGTTTGAATCTCCCAAGAAGAAGAG

GAAAGTAAAGATAATATCTCGAAAAAGTCTTGGTACCCAAAATGTCTATG

ATATTGGAGTGGAGAAAGATCACAACTTCCTTCTCAAGAACGGTCTCGTA

GCCAGCAAC

Cfa-C Protein:

(SEQ ID NO: 51)
MKRTADGSEFESPKKKRKVKIISRKSLGTQNVYDIGVEKDHNFLLKNGLV

ASN

Intein-N and intein-C may be fused to the N-terminal portion of the split Cas9 and the C-terminal portion of the split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N—[N-terminal portion of the split Cas9]-[intein-N]—C. In some embodiments, an intein-C is fused to the N-terminus of the C-terminal portion of the split Cas9, i.e., to form a structure of N-[intein-C]-[C-terminal portion of the split Cas9]-C. The mechanism of intein-mediated protein splicing for joining the proteins the inteins are fused to (e.g., split Cas9) is known in the art, e.g., as described in Shah et al., Chem Sci. 2014; 5(1):446-461, incorporated herein by reference. Methods for designing and using inteins are known in the art and described, for example by WO2014004336, WO2017132580, US20150344549, and US20180127780, each of which is incorporated herein by reference in their entirety.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high-performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

By an "isolated polypeptide" is meant a polypeptide of the invention that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. An isolated polypeptide of the invention may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

The term "linker", as used herein, can refer to a covalent linker (e.g., covalent bond), a non-covalent linker, a chemical group, or a molecule linking two molecules or moieties, e.g., two components of a protein complex or a ribonucleocomplex, or two domains of a fusion protein, such as, for example, a polynucleotide programmable DNA binding domain (e.g., dCas9) and a deaminase domain ((e.g., an adenosine deaminase, or an adenosine deaminase and a cytidine deaminase, e.g., as described in PCT/US19/44935). A linker can join different components of, or different portions of components of, a base editor system. For example, in some embodiments, a linker can join a guide polynucleotide binding domain of a polynucleotide programmable nucleotide binding domain and a catalytic domain of a deaminase. In some embodiments, a linker can join a CRISPR polypeptide and a deaminase. In some embodiments, a linker can join a Cas9 and a deaminase. In some embodiments, a linker can join a dCas9 and a deaminase. In some embodiments, a linker can join a nCas9 and a deaminase. In some embodiments, a linker can join a guide polynucleotide and a deaminase. In some embodiments, a linker can join a deaminating component and a polynucleotide programmable nucleotide binding component of a base editor system. In some embodiments, a linker can join a RNA-binding portion of a deaminating component and a polynucleotide programmable nucleotide binding component of a base editor system. In some embodiments, a linker can join a RNA-binding portion of a deaminating component and a RNA-binding portion of a polynucleotide programmable nucleotide binding component of a base editor system. A linker can be positioned between, or flanked by, two groups, molecules, or other moieties and connected to each one via a covalent bond or non-covalent interaction, thus connecting the two. In some embodiments, the linker can be an organic molecule, group, polymer, or chemical moiety. In some embodiments, the linker can be a polynucleotide. In some embodiments, the linker can be a DNA linker. In some embodiments, the linker can be a RNA linker. In some embodiments, a linker can comprise an aptamer capable of binding to a ligand. In some embodiments, the ligand may be carbohydrate, a peptide, a protein, or a nucleic acid. In some embodiments, the linker may comprise an aptamer may be derived from a riboswitch. The riboswitch from which the aptamer is derived may be selected from a theophylline riboswitch, a thiamine pyrophosphate (TPP) riboswitch, an adenosine cobalamin (AdoCbl) riboswitch, an S-adenosyl methionine (SAM) riboswitch, an SAH riboswitch, a flavin mononucleotide (FMN) riboswitch, a tetrahydrofolate riboswitch, a lysine riboswitch, a glycine riboswitch, a purine riboswitch, a GlmS riboswitch, or a pre-queosine1 (PreQ1) riboswitch. In some embodiments, a linker may comprise an aptamer bound to a polypeptide or a protein domain, such as a polypeptide ligand. In some embodiments, the polypeptide ligand may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif. In some embodiments, the polypeptide ligand may be a portion of a base editor system component. For example, a nucleobase editing component may comprise a deaminase domain and a RNA recognition motif.

In some embodiments, the linker can be an amino acid or a plurality of amino acids (e.g., a peptide or protein). In some embodiments, the linker can be about 5-100 amino acids in length, for example, about 5, 6, 7, 8, 9, 10, 11, 12, 13, 14, 15, 16, 17, 18, 19, 20, 20-30, 30-40, 40-50, 50-60, 60-70, 70-80, 80-90, or 90-100 amino acids in length. In some embodiments, the linker can be about 100-150, 150-200, 200-250, 250-300, 300-350, 350-400, 400-450, or 450-500 amino acids in length. Longer or shorter linkers can be also contemplated.

In some embodiments, a linker joins a gRNA binding domain of an RNA-programmable nuclease, including a Cas9 nuclease domain, and the catalytic domain of a nucleic-acid editing protein (e.g., adenosine deaminase). In some embodiments, a linker joins a dCas9 and a nucleic-acid editing protein. For example, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-200 amino acids in length, for example, 5, 6, 7, 8, 9, 10, 11, 12, 13, 14, 15, 16, 17, 18, 19, 20, 25, 35, 45, 50, 55, 60, 60, 65, 70, 70, 75, 80, 85, 90, 90, 95, 100, 101, 102, 103, 104, 105, 110, 120, 130, 140, 150, 160, 175, 180, 190, or 200 amino acids in length. Longer or shorter linkers are also contemplated.

In some embodiments, the domains of the nucleobase editor are fused via a linker that comprises the amino acid sequence of SGGSSGSETPGTSESATPESSGGS (SEQ ID NO: 52), SGGSSGGSSSGSETPGTSESATPESSGGSSGGS (SEQ ID NO: 53), or GGSGGSPGSPAGSPTSTEEGTS-ESATPESGPGTSTEPSEGSAPGSPAGSPTSTEEGTSTE PSEGSAPGTSTEPSEGSAPGTSESAT-PESGPGSEPATSGGSGGS (SEQ ID NO: 54).

In some embodiments, domains of the nucleobase editor are fused via a linker comprising the amino acid sequence SGSETPGTSESATPES (SEQ ID NO: 55), which may also be referred to as the XTEN linker. In some embodiments, a linker comprises the amino acid sequence SGGS (SEQ ID NO: 56). In some embodiments, a linker comprises (SGGS)$_n$ (SEQ ID NO: 57), (GGGS)$_n$ (SEQ ID NO: 58), (GGGGS)$_n$ (SEQ ID NO: 59), (G)$_n$ (SEQ ID NO: 60), (EAAAK)$_n$ (SEQ ID NO: 61), (GGS)$_n$ (SEQ ID NO: 62), SGSETPGTSESAT-PES (SEQ ID NO: 55), or (XP)$_n$ motif (SEQ ID NO: 63), or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

In some embodiments, the linker is 24 amino acids in length. In some embodiments, the linker comprises the amino acid sequence SGGSSGGSSSGSETPGTSESATPES (SEQ ID NO: 64). In some embodiments, the linker is 40 amino acids in length. In some embodiments, the linker comprises the amino acid sequence SGGSSGGSSSGSETPGTSESAT-PESSGGSSGGSSSGGSSGGSSGSETPGTSESAT-PESSGGS SGGS (SEQ ID NO: 65). In some embodiments, the linker is 64 amino acids in length. In some embodiments, the linker comprises the amino acid sequence SGGSSGGSSSGSETPGTSESAT-PESSGGSSGGSSSGGSSGGSSGSETPGTSESAT-PESSGGS SGGS (SEQ ID NO: 66). In some embodiments, the linker is 92 amino acids in length. In some embodiments, the linker comprises the amino acid sequence PGSPAGSPTSTEEGTSESATPESGPGT-STEPSEGSAPGSPAGSPTSTEEGTSTEPSEGSAPG TSTEPSEGSAPGTSESATPESGPGSEPATS (SEQ ID NO: 67).

By "marker" is meant any protein or polynucleotide having an alteration in expression level or activity that is associated with a disease or disorder.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)). In some embodiments, the presently disclosed base editors can efficiently generate an "intended mutation," such as a point mutation, in a nucleic acid (e.g., a nucleic acid within a genome of a subject) without generating a significant number of unintended mutations, such as unintended point mutations. In some embodiments, an intended mutation is a mutation that is generated by a specific base editor (e.g., an adenosine base editor) bound to a guide polynucleotide (e.g., gRNA), specifically designed to generate the intended mutation.

In general, mutations made or identified in a sequence (e.g., an amino acid sequence as described herein) are numbered in relation to a reference (or wild type) sequence, i.e., a sequence that does not contain the mutations. The skilled practitioner in the art would readily understand how to determine the position of mutations in amino acid and nucleic acid sequences relative to a reference sequence.

The term "non-conservative mutations" involve amino acid substitutions between different groups, for example, lysine for tryptophan, or phenylalanine for serine, etc. In this case, it is preferable for the non-conservative amino acid substitution to not interfere with, or inhibit the biological activity of, the functional variant. The non-conservative amino acid substitution can enhance the biological activity of the functional variant, such that the biological activity of the functional variant is increased as compared to the wild-type protein.

The term "nuclear localization sequence," "nuclear localization signal," or "NLS" refers to an amino acid sequence that promotes import of a protein into the cell nucleus. Nuclear localization sequences are known in the art and described, for example, in Plank et al., International PCT application, PCT/EP2000/011690, filed Nov. 23, 2000, published as WO/2001/038547 on May 31, 2001, the contents of which are incorporated herein by reference for their disclosure of exemplary nuclear localization sequences. In other embodiments, the NLS is an optimized NLS described, for example, by Koblan et al., Nature Biotech. 2018 doi: 10.1038/nbt.4172. In some embodiments, an NLS comprises the amino acid sequence KRTADGSEFESPKKKRKV (SEQ ID NO: 68), KRPAATKKAGQAKKKK (SEQ ID NO: 69), KKTELQTTNAENKTKKL (SEQ ID NO: 70), KRGIN-DRNFWRGENGRKTR (SEQ ID NO: 71), RKSGKIAAIV-VKRPRK (SEQ ID NO: 72), PKKKRKV (SEQ ID NO: 73), or MDSLLMNRRKFLYQFKNVRWAKGRRETYLC (SEQ ID NO: 74)

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (2'—e.g., fluororibose, ribose, 2'-deoxyribose, arabinose, and hexose); and/or modified phosphate groups (e.g., phosphorothioates and 5'-N-phosphoramidite linkages).

The term "nucleic acid programmable DNA binding protein" or "napDNAbp" may be used interchangeably with "polynucleotide programmable nucleotide binding domain" to refer to a protein that associates with a nucleic acid (e.g., DNA or RNA), such as a guide nucleic acid or guide polynucleotide (e.g., gRNA), that guides the napDNAbp to a specific nucleic acid sequence. In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the polynucleotide programmable nucleotide binding domain is a Cas9 protein. A Cas9 protein can associate with a guide RNA that guides the Cas9 protein to a specific DNA sequence that is complementary to the guide RNA. In some embodiments, the napDNAbp is a Cas9 domain, for example a nuclease active Cas9, a Cas9 nickase (nCas9), or a nuclease inactive Cas9 (dCas9). Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" *CRISPR J.* 2018 October; 1:325-336. doi: 10.1089/crispr.2018.0033; Yan et al., "Functionally diverse type V CRISPR-Cas systems" *Science.* 2019 Jan. 4; 363(6422):88-91. doi: 10.1126/science.aav7271, the entire contents of each are hereby incorporated by reference.

The term "nucleobase," "nitrogenous base," or "base," used interchangeably herein, refers to a nitrogen-containing biological compound that forms a nucleoside, which in turn is a component of a nucleotide. The ability of nucleobases to form base pairs and to stack one upon another leads directly to long-chain helical structures such as ribonucleic acid (RNA) and deoxyribonucleic acid (DNA). Five nucleobases—adenine (A), cytosine (C), guanine (G), thymine (T), and uracil (U)—are called primary or canonical. Adenine and guanine are derived from purine, and cytosine, uracil, and thymine are derived from pyrimidine. DNA and RNA can also contain other (non-primary) bases that are modified. Non-limiting exemplary modified nucleobases can include hypoxanthine, xanthine, 7-methylguanine, 5,6-dihydrouracil, 5-methylcytosine (m5C), and 5-hydromethylcytosine. Hypoxanthine and xanthine can be created through mutagen presence, both of them through deamination (replacement of the amine group with a carbonyl group). Hypoxanthine can be modified from adenine. Xanthine can be modified from guanine. Uracil can result from deamination of cytosine. A "nucleoside" consists of a nucleobase and a five carbon sugar (either ribose or deoxyribose). Examples of a nucleoside include adenosine, guanosine, uridine, cytidine, 5-methyluridine (m5U), deoxyadenosine, deoxyguanosine, thymidine, deoxyuridine, and deoxycytidine. Examples of a nucleoside with a modified nucleobase includes inosine (I), xanthosine (X), 7-methylguanosine (m7G), dihydrouridine (D), 5-methylcytidine (m5C), and pseudouridine (Ψ). A "nucleotide" consists of a nucleobase, a five carbon sugar (either ribose or deoxyribose), and at least one phosphate group.

The terms "nucleobase editing domain" or "nucleobase editing protein," as used herein, refers to a protein or enzyme that can catalyze a nucleobase modification in RNA or DNA, such as cytosine (or cytidine) to uracil (or uridine) or thymine (or thymidine), and adenine (or adenosine) to hypoxanthine (or inosine) deaminations, as well as non-templated nucleotide additions and insertions. In some embodiments, the nucleobase editing domain is a deaminase domain (e.g., an adenine deaminase or an adenosine deaminase; or a cytidine deaminase or a cytosine deaminase). In some embodiments, the nucleobase editing domain is more than one deaminase domain (e.g., an adenine deaminase, or an adenosine deaminase and a cytidine or a cytosine deaminase, e.g., as described in PCT/US19/44935). In some embodiments, the nucleobase editing domain can be a naturally occurring nucleobase editing domain. In some embodiments, the nucleobase editing domain can be an engineered or evolved nucleobase editing domain from the naturally occurring nucleobase editing domain. The nucleobase editing domain can be from any organism, such as a bacterium, human, chimpanzee, gorilla, monkey, cow, dog, rat, or mouse.

As used herein, "obtaining" as in "obtaining an agent" includes synthesizing, purchasing, generating, preparing, or otherwise acquiring the agent.

A "patient" or "subject" as used herein refers to a mammalian subject or individual diagnosed with, having, at risk of having or developing, susceptible to, or suspected of having or developing a disease or a disorder. In some embodiments, the term "patient" refers to a mammalian subject with a higher than average likelihood of developing a disease or a disorder. Exemplary patients can be humans, non-human primates, cats, dogs, pigs, cattle, cats, horses, camels, llamas, goats, sheep, rodents (e.g., mice, rabbits, rats, or guinea pigs) and other mammals that can benefit from the therapies disclosed herein. Exemplary human patients can be male and/or female.

"Patient in need thereof" or "subject in need thereof" is referred to herein as a patient diagnosed with, at risk or having, predetermined to have, or suspected of having a disease or disorder.

The terms "pathogenic mutation," "pathogenic variant," "disease casing mutation," "disease causing variant," "deleterious mutation," or "predisposing mutation" refers to a genetic alteration or mutation that increases an individual's susceptibility or predisposition to a certain disease or disorder. In some embodiments, the pathogenic mutation comprises at least one wild-type amino acid substituted by at least one pathogenic amino acid in a protein encoded by a gene.

The terms "protein," "peptide," "polypeptide," and their grammatical equivalents are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide can refer to an individual protein or a collection of proteins. One or more of the amino acids in a protein, peptide, or polypeptide can be modified, for example, by the addition of a chemical entity such as a carbohydrate group, a hydroxyl group, a phosphate group, a farnesyl group, an isofarnesyl group, a fatty acid group, a linker for conjugation, functionalization, or other modifications, etc. A protein, peptide, or polypeptide can also be a single molecule or can be a multi-molecular complex. A protein, peptide, or polypeptide can be just a fragment of a naturally occurring protein or peptide. A protein, peptide, or polypeptide can be naturally occurring, recombinant, or synthetic, or any combination thereof. The term "fusion protein" as used herein refers to a hybrid polypeptide which comprises protein domains from at least two different proteins. One protein can be located at the amino-terminal (N-terminal) portion of the fusion protein or at the carboxy-terminal (C-terminal) protein thus forming an amino-terminal fusion protein or a carboxy-terminal fusion protein, respectively. A protein can comprise different domains, for example, a nucleic acid binding domain (e.g., the gRNA binding domain of Cas9 that directs the binding of the protein to a target site) and a nucleic acid cleavage domain, or a catalytic domain of a nucleic acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA or DNA. Any of the proteins provided herein can be produced by any method known in the art. For example, the proteins provided herein can be produced via recombinant protein expression and purification, which is especially suited for fusion proteins comprising a peptide linker. Methods for recombinant protein expression and purification are well known, and include those described by Green and Sambrook, Molecular Cloning: A Laboratory Manual (4th ed., Cold Spring Harbor Laboratory Press, Cold Spring Harbor, N.Y. (2012)), the entire contents of which are incorporated herein by reference.

Polypeptides and proteins disclosed herein (including functional portions and functional variants thereof) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N'-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine. The polypeptides and proteins can be associated with post-translational modifications of one or more amino acids of the polypeptide constructs. Non-limiting examples of post-translational modifications include phosphorylation, acylation including acetylation and formylation, glycosylation (including N-linked and O-linked), amidation, hydroxylation, alkylation including methylation and ethylation, ubiquitylation, addition of pyrrolidone carboxylic acid, formation of disulfide bridges, sulfation, myristoylation, palmitoylation, isoprenylation, farnesylation, geranylation, glypiation, lipoylation and iodination.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

By "reduces" is meant a negative alteration of at least 10%, 25%, 50%, 75%, or 100%.

By "reference" is meant a standard or control condition. In one embodiment, the reference is a wild-type or healthy cell. In other embodiments and without limitation, a reference is an untreated cell that is not subjected to a test condition, or is subjected to placebo or normal saline, medium, buffer, and/or a control vector that does not harbor a polynucleotide of interest.

A "reference sequence" is a defined sequence used as a basis for sequence comparison. A reference sequence may be a subset of or the entirety of a specified sequence; for example, a segment of a full-length cDNA or gene sequence, or the complete cDNA or gene sequence. For polypeptides, the length of the reference polypeptide sequence will generally be at least about 16 amino acids, at least about 20 amino acids, more at least about 25 amino acids, and even more preferably about 35 amino acids, about 50 amino acids, or about 100 amino acids. For nucleic acids, the length of the reference nucleic acid sequence will generally be at least about 50 nucleotides, at least about 60 nucleotides, at least about 75 nucleotides, and about 100 nucleotides or about 300 nucleotides or any integer thereabout or therebetween. In some embodiments, a reference sequence is a wild-type sequence of a protein of interest. In other embodiments, a reference sequence is a polynucleotide sequence encoding a wild-type protein.

The term "RNA-programmable nuclease," and "RNA-guided nuclease" are used with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et ah, Science 337:816-821 (2012), the entire contents of which is incorporated herein by reference. Other examples of gRNAs (e.g., those including domain 2) can be found in U.S. Provisional Patent Application Ser. No. 61/874,682, filed Sep. 6, 2013, entitled "Switchable Cas9 Nucleases and Uses Thereof," and U.S. Provisional Patent Application Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex.

In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C, Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C M., Gonzales K., Chao Y., Pirzada Z. A., Eckert M. R., Vogel J., Charpentier E., Nature 471:602-607 (2011).

Because RNA-programmable nucleases (e.g., Cas9) use RNA:DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. Science 339, 819-823 (2013); *Mali*, P. et ah, RNA-guided human genome engineering via Cas9. Science 339, 823-826 (2013); Hwang, W. Y. et al., Efficient genome editing in zebrafish using a CRISPR-Cas system. *Nature biotechnology* 31, 227-229 (2013); Jinek, M. et ah, RNA-programmed genome editing in human cells. eLife 2, e00471 (2013); Dicarlo, J. E. et al., Genome engineering in *Saccharomyces cerevisiae* using CRISPR-Cas systems. *Nucleic acids research* (2013); Jiang, W. et ah RNA-guided editing of bacterial genomes using CRISPR-Cas systems. *Nature biotechnology* 31, 233-239 (2013); the entire contents of each of which are incorporated herein by reference).

The term "single nucleotide polymorphism (SNP)" is a variation in a single nucleotide that occurs at a specific position in the genome, where each variation is present to some appreciable degree within a population (e.g., >1%). For example, at a specific base position in the human genome, the C nucleotide can appear in most individuals, but in a minority of individuals, the position is occupied by an A. This means that there is a SNP at this specific position, and the two possible nucleotide variations, C or A, are said to be alleles for this position. SNPs underlie differences in susceptibility to disease. The severity of illness and the way our body responds to treatments are also manifestations of genetic variations. SNPs can fall within coding regions of genes, non-coding regions of genes, or in the intergenic regions (regions between genes). In some embodiments, SNPs within a coding sequence do not necessarily change the amino acid sequence of the protein that is produced, due to degeneracy of the genetic code. SNPs in the coding region are of two types: synonymous and nonsynonymous SNPs. Synonymous SNPs do not affect the protein sequence, while nonsynonymous SNPs change the amino acid sequence of protein. The nonsynonymous SNPs are of two types: missense and nonsense. SNPs that are not in protein-coding regions can still affect gene splicing, transcription factor binding, messenger RNA degradation, or the sequence of noncoding RNA. Gene expression affected by this type of SNP is referred to as an eSNP (expression SNP) and can be upstream or downstream from the gene. A single nucleotide variant (SNV) is a variation in a single nucleotide without any limitations of frequency and can arise in somatic cells. A somatic single nucleotide variation can also be called a single-nucleotide alteration.

By "specifically binds" is meant a nucleic acid molecule, polypeptide, or complex thereof (e.g., a nucleic acid programmable DNA binding domain and guide nucleic acid), compound, or molecule that recognizes and binds a polypeptide and/or nucleic acid molecule of the invention, but which does not substantially recognize and bind other molecules in a sample, for example, a biological sample.

Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. Nucleic acid molecules useful in the methods of the invention include any nucleic acid molecule that encodes a polypeptide of the invention or a fragment thereof. Such nucleic acid molecules need not be 100% identical with an endogenous nucleic acid sequence, but will typically exhibit substantial identity. Polynucleotides having "substantial identity" to an endogenous sequence are typically capable of hybridizing with at least one strand of a double-stranded nucleic acid molecule. By "hybridize" is meant pair to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507).

For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a one: embodiment, hybridization will occur at 30° C. in 750 mM NaCl, 75 mM trisodium citrate, and 1% SDS. In another embodiment, hybridization will occur at 37° C. in 500 mM NaCl, 50 mM trisodium citrate, 1% SDS, 35% formamide, and 100 µg/ml denatured salmon sperm DNA (ssDNA). In another embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In an embodiment, wash steps will occur at 25° C. in 30 mM NaCl, 3 mM trisodium citrate, and 0.1% SDS. In a more preferred embodiment, wash steps will occur at 42 C in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

By "split" is meant divided into two or more fragments. A "split Cas9 protein" or "split Cas9" refers to a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a "reconstituted" Cas9 protein. In particular embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351: 867-871. PDB file: 5F9R, each of which is incorporated herein by reference. In some embodiments, the protein is divided into two fragments at any C, T, A, or S within a region of SpCas9 between about amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, 5469, or C574. In some embodiments, the process of dividing the protein into two fragments is referred to as "splitting" the protein.

In other embodiments, the N-terminal portion of the Cas9 protein comprises amino acids 1-573 or 1-637 of S. pyogenes Cas9 wild-type (SpCas9) (NCBI Reference Sequence: NC_002737.2, Uniprot Reference Sequence: Q99ZW2), or a corresponding position/mutation thereof, and the C-terminal portion of the Cas9 protein comprises a portion of amino acids 574-1368 or 638-1368 of SpCas9 wild-type.

The C-terminal portion of the split Cas9 can be joined with the N-terminal portion of the split Cas9 to form a complete Cas9 protein. In some embodiments, the C-terminal portion of the Cas9 protein starts from where the N-terminal portion of the Cas9 protein ends. As such, in some embodiments, the C-terminal portion of the split Cas9 comprises a portion of amino acids (551-651)-1368 of spCas9. "(551-651)-1368" means starting at an amino acid between amino acids 551-651 (inclusive) and ending at amino acid 1368. For example, the C-terminal portion of the split Cas9 may comprise a portion of any one of amino acid 551-1368, 552-1368, 553-1368, 554-1368, 555-1368, 556-1368, 557-1368, 558-1368, 559-1368, 560-1368, 561-1368, 562-1368, 563-1368, 564-1368, 565-1368, 566-1368, 567-1368, 568-1368, 569-1368, 570-1368, 571-1368, 572-1368, 573-1368, 574-1368, 575-1368, 576-1368, 577-1368, 578-1368, 579-1368, 580-1368, 581-1368, 582-1368, 583-1368, 584-1368, 585-1368, 586-1368, 587-1368, 588-1368, 589-1368, 590-1368, 591-1368, 592-1368, 593-1368, 594-1368, 595-1368, 596-1368, 597-1368, 598-1368, 599-1368, 600-1368, 601-1368, 602-1368, 603-1368, 604-1368, 605-1368, 606-1368, 607-1368, 608-1368, 609-1368, 610-1368, 611-1368, 612-1368, 613-1368, 614-1368, 615-1368, 616-1368, 617-1368, 618-1368, 619-1368, 620-1368, 621-1368, 622-1368, 623-1368, 624-1368, 625-1368, 626-1368, 627-1368, 628-1368, 629-1368, 630-1368, 631-1368, 632-1368, 633-1368, 634-1368, 635-1368, 636-1368, 637-1368, 638-1368, 639-1368, 640-1368, 641-1368, 642-1368, 643-1368, 644-1368, 645-1368, 646-1368, 647-1368, 648-1368, 649-1368, 650-1368, or 651-1368 of spCas9. In some embodiments, the C-terminal portion of the split Cas9 protein comprises a portion of amino acids 574-1368 or 638-1368 of SpCas9.

By "subject" is meant a mammal, including, but not limited to, a human or non-human mammal, such as a bovine, equine, canine, ovine, or feline. Subjects include livestock, domesticated animals raised to produce labor and to provide commodities, such as food, including without limitation, cattle, goats, chickens, horses, pigs, rabbits, and sheep.

By "substantially identical" is meant a polypeptide or nucleic acid molecule exhibiting at least 50% identity to a reference amino acid sequence (for example, any one of the amino acid sequences described herein) or nucleic acid sequence (for example, any one of the nucleic acid sequences described herein). In one embodiment, such a sequence is at least 60%, 80% or 85%, 90%, 95% or even 99% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence. COBALT is used, for example, with the following parameters:
   a) alignment parameters: Gap penalties-11, -1 and End-Gap penalties-5, -1,
   b) CDD Parameters: Use RPS BLAST on; Blast E-value 0.003; Find Conserved columns and Recompute on, and
   c) Query Clustering Parameters: Use query clusters on; Word Size 4; Max cluster distance 0.8; Alphabet Regular.

EMBOSS Needle is used, for example, with the following parameters:
   a) Matrix: BLOSUM62;
   b) GAP OPEN: 10;
   c) GAP EXTEND: 0.5;
   d) OUTPUT FORMAT: pair;
   e) END GAP PENALTY: false;
   f) END GAP OPEN: 10; and
   g) END GAP EXTEND: 0.5.

The term "target site" refers to a sequence within a nucleic acid molecule that is modified by a nucleobase editor. In one embodiment, the target site is deaminated by a deaminase or a fusion protein comprising a deaminase (e.g., adenine deaminase).

As used herein, the terms "treat," treating," "treatment," and the like refer to reducing or ameliorating a disease, disorder and/or symptoms associated therewith or obtaining a desired pharmacologic and/or physiologic effect. It will be appreciated that, although not precluded, treating a disorder or condition does not require that the disorder, condition or symptoms associated therewith be completely eliminated. In some embodiments, the effect is therapeutic, i.e., without limitation, the effect partially or completely reduces, diminishes, abrogates, abates, alleviates, decreases the intensity of, or cures a disease and/or adverse symptom attributable to the disease. In some embodiments, the effect is preventative, i.e., the effect protects or prevents an occurrence or reoccurrence of a disease or condition. To this end, the presently disclosed methods comprise administering a therapeutically effective amount of a compositions as described herein. In some embodiments, the disease or disorder is sickle cell disease (SCD) or β-thalassemia.

By "uracil glycosylase inhibitor" or "UGI" is meant an agent that inhibits the uracil-excision repair system. In one embodiment, the agent is a protein or fragment thereof that binds a host uracil-DNA glycosylase and prevents removal of uracil residues from DNA. In an embodiment, a UGI is a protein, a fragment thereof, or a domain that is capable of inhibiting a uracil-DNA glycosylase base-excision repair enzyme. In some embodiments, a UGI domain comprises a wild-type UGI or a modified version thereof. In some embodiments, a UGI domain comprises a fragment of the exemplary amino acid sequence set forth below. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or 100% of the exemplary UGI sequence provided below. In some embodiments, a UGI comprises an amino acid sequence that is homologous to the exemplary UGI amino acid sequence or fragment thereof, as set forth below. In some embodiments, the UGI, or a portion thereof, is at least 70%, at least 75%, at least 80%, at least 85%, at least 90%, at least 95%, at least 96%, at least 97%, at least 98%, at least 99%, at least 99.5%, at least 99.9%, or 100% identical to a wild type UGI or a UGI sequence, or portion thereof, as set forth below. An exemplary UGI comprises an amino acid sequence as follows: >sp1P14739IUNGI BPPB2 Uracil-DNA glycosylase inhibitor MTNLSDIIEKETGKQLVIQESILMLPEEVEEVI-GNKPESDILVHTAYDESTDENVMLLTSD APEYKP-WALVIQDSNGENKIKML (SEQ ID NO: 75).

The term "vector" refers to a means of introducing a nucleic acid sequence into a cell, resulting in a transformed cell. Vectors include plasmids, transposons, phages, viruses, liposomes, and episome. "Expression vectors" are nucleic acid sequences comprising the nucleotide sequence to be expressed in the recipient cell. Expression vectors may include additional nucleic acid sequences to promote and/or facilitate the expression of the of the introduced sequence such as start, stop, enhancer, promoter, and secretion sequences.

Any compositions or methods provided herein can be combined with one or more of any of the other compositions and methods provided herein.

DNA editing has emerged as a viable means to modify disease states by correcting pathogenic mutations at the genetic level. Until recently, all DNA editing platforms have functioned by inducing a DNA double strand break (DSB) at a specified genomic site and relying on endogenous DNA repair pathways to determine the product outcome in a semi-stochastic manner, resulting in complex populations of genetic products. Though precise, user-defined repair outcomes can be achieved through the homology directed repair (HDR) pathway, a number of challenges have prevented high efficiency repair using HDR in therapeutically-relevant cell types. In practice, this pathway is inefficient relative to the competing, error-prone non-homologous end joining pathway. Further, HDR is tightly restricted to the G1 and S phases of the cell cycle, preventing precise repair of DSBs in post-mitotic cells. As a result, it has proven difficult or impossible to alter genomic sequences in a user-defined, programmable manner with high efficiencies in these populations.

BRIEF DESCRIPTION OF THE DRAWINGS

FIG. 1A is an expression vector encoding a TadA7.10-dCas9 base editor. FIG. 1B is a plasmid comprising nucleic acid molecules encoding proteins that confer chloramphenicol resistance (CamR) and spectinomycin resistance (SpectR). The plasmid also comprises a kanamycin resistance gene disabled by two point mutations. FIG. 1C is a plasmid comprising nucleic acid molecules encoding proteins that confer chloramphenicol resistance (CamR) and spectinomycin resistance (SpectR).

The plasmid also comprises a kanamycin resistance gene disabled by three point mutations.

Figure 1A:
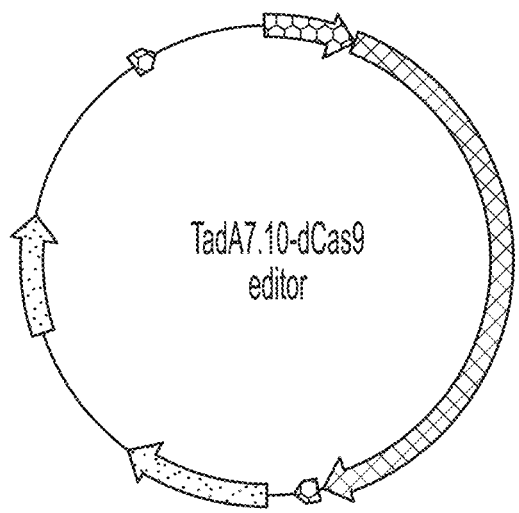
FIGS. 1A-1C depict plasmids.
Figure 1B:
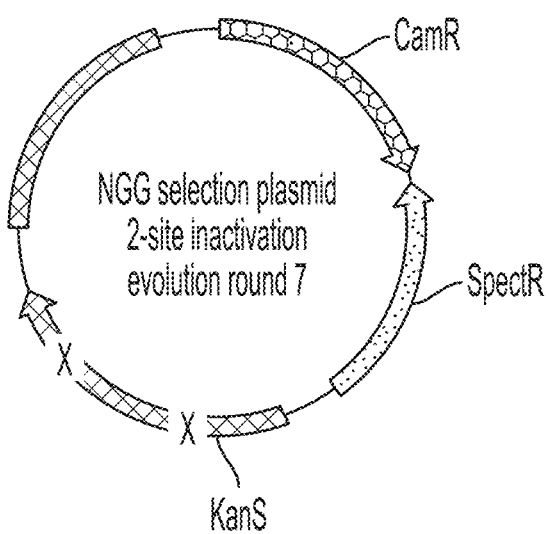
Figure 1C:
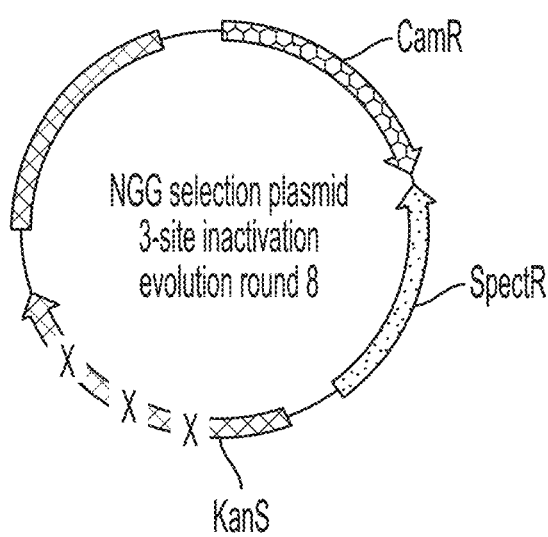
Figure 2:
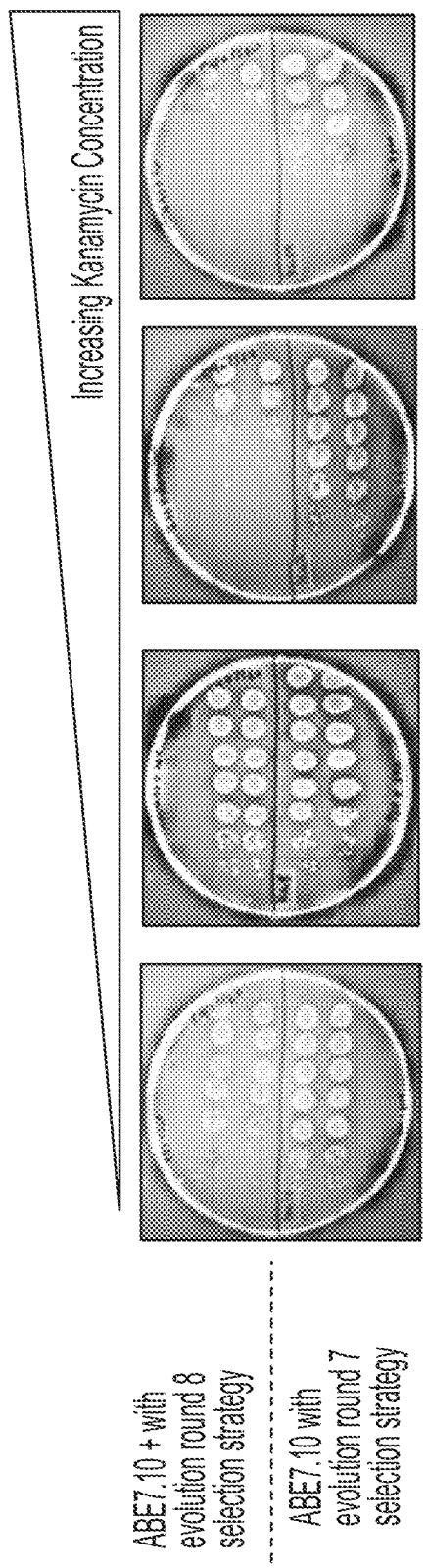

FIG. 2 presents images of bacterial colonies transduced with the expression vectors depicted in FIG. 1, which included a defective kanamycin resistance gene. The vectors contained ABE7.10 variants that were generated using error prone PCR. Bacterial cells expressing these "evolved" ABE7.10 variants were selected for kanamycin resistance using increasing concentrations of kanamycin. Bacteria expressing ABE7.10 variants having adenosine deaminase activity were capable of correcting the mutations introduced into the kanamycin resistance gene, thereby restoring kanamycin resistance. The kanamycin resistant cells were selected for further analysis.

Figure 3A:
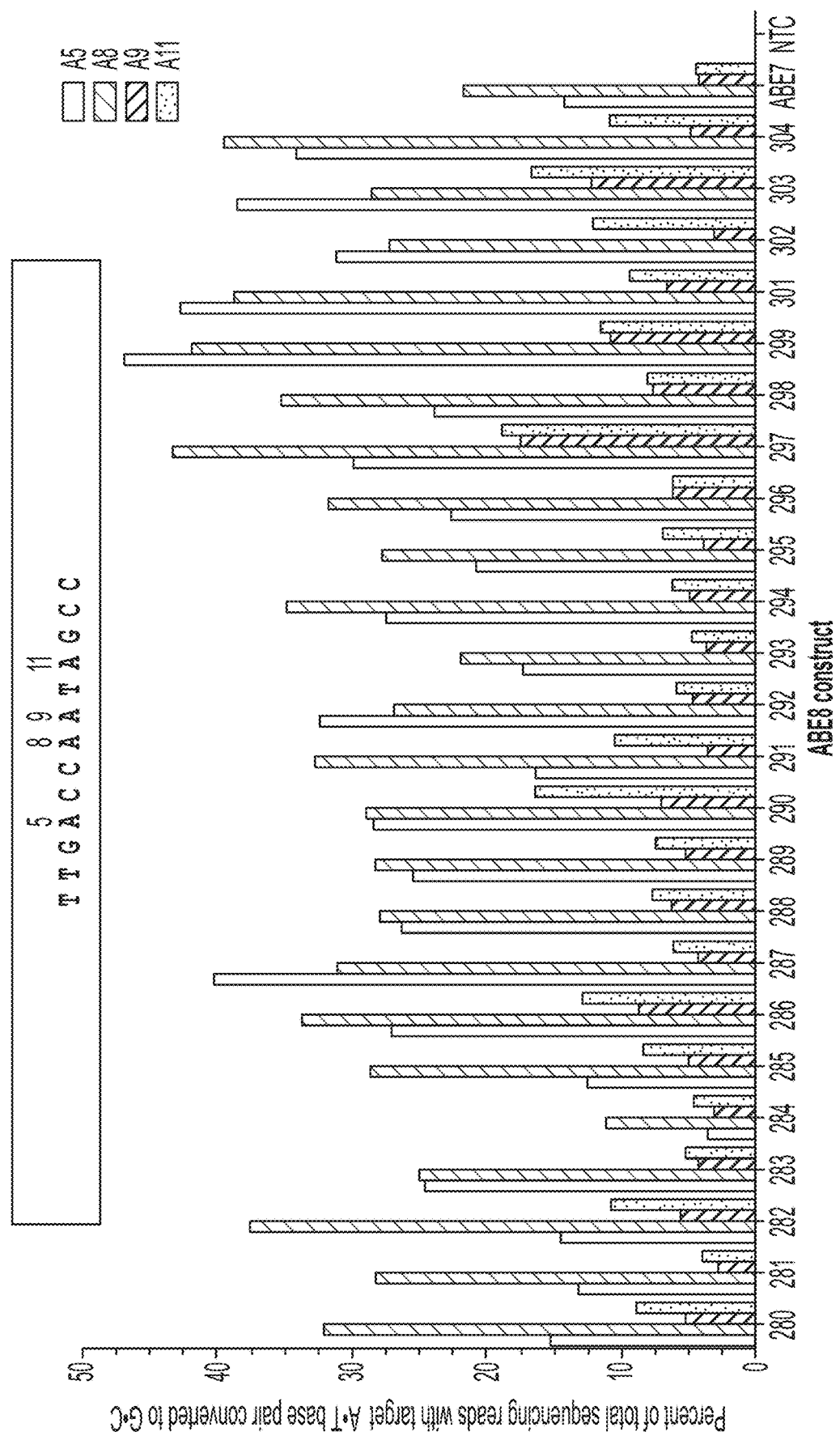
Figure 3B:
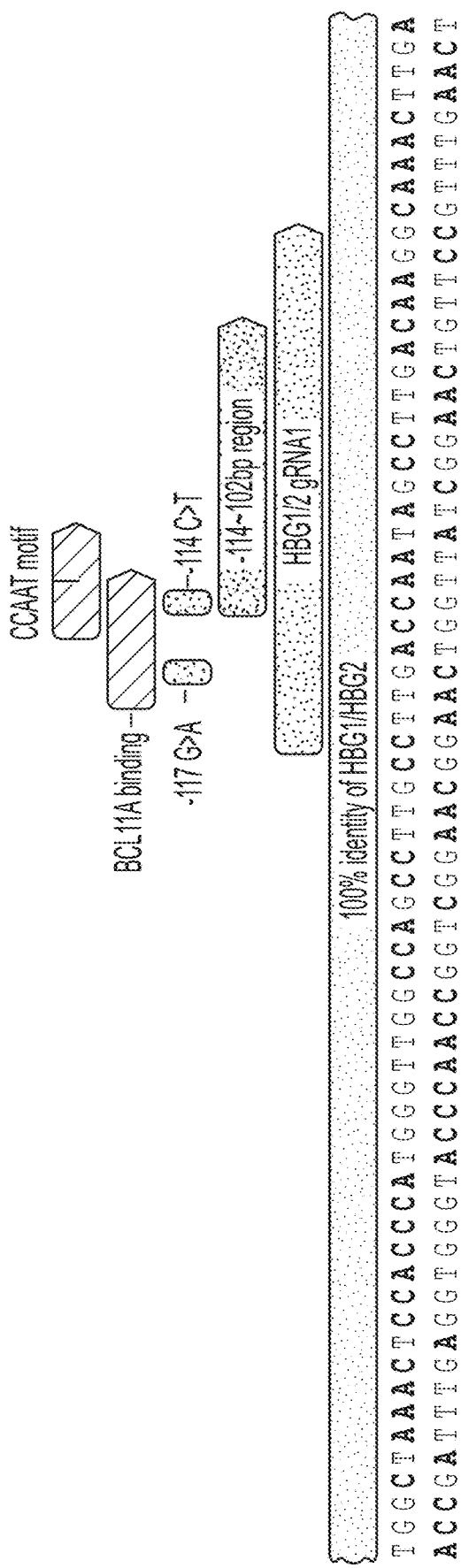

FIGS. 3A and 3B illustrate editing of a regulatory region of the hemoglobin subunit gamma (HGB1) locus, which is a therapeutically relevant site for upregulation of fetal hemoglobin. FIG. 3A is a graph that quantifies the efficiency and specificity of adenosine deaminase variants listed in Table 15. FIG. 3B is a drawing of a portion of the regulatory region for the HGB1 gene. FIG. 3B discloses SEQ ID NO: 296. Editing is assayed at the hemoglobin subunit gamma 1 (HGB1) locus in HEK293T cells, which is therapeutically relevant site for upregulation of fetal hemoglobin. The top panel depicts nucleotide residues in the target region of the regulatory sequence of the HGB1 gene. A5, A8, A9, and A11 denote the edited adenosine residues in HGB1. FIG. 3A discloses SEQ ID NO: 295.

Figure 4:
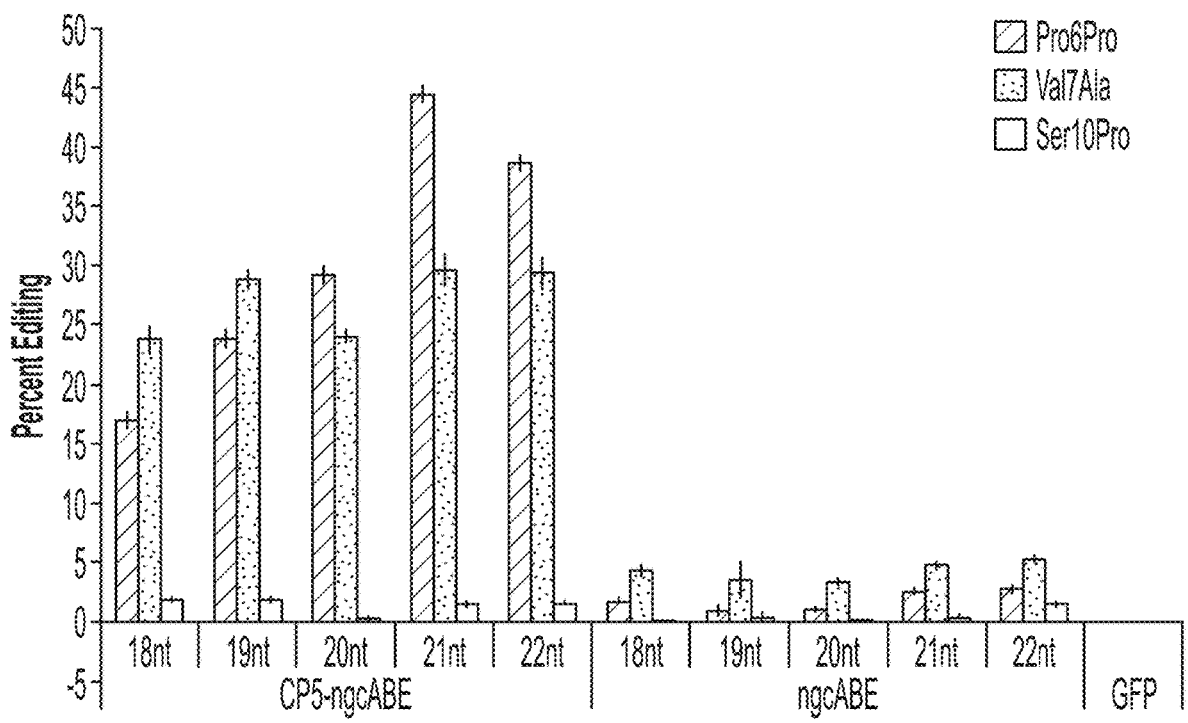

FIG. 4 illustrates the relative effectiveness of adenosine base editors comprising a dCas9 that recognizes a noncanonical PAM sequence. The top panel depicts the coding sequence of the hemoglobin subunit. The bottom panel is a graph demonstrating the efficiency of adenosine deaminase variant base editors with guide RNAs of varying lengths. FIG. 4 discloses SEQ ID NOS 297-298, respectively, in order of appearance.

Figure 5:
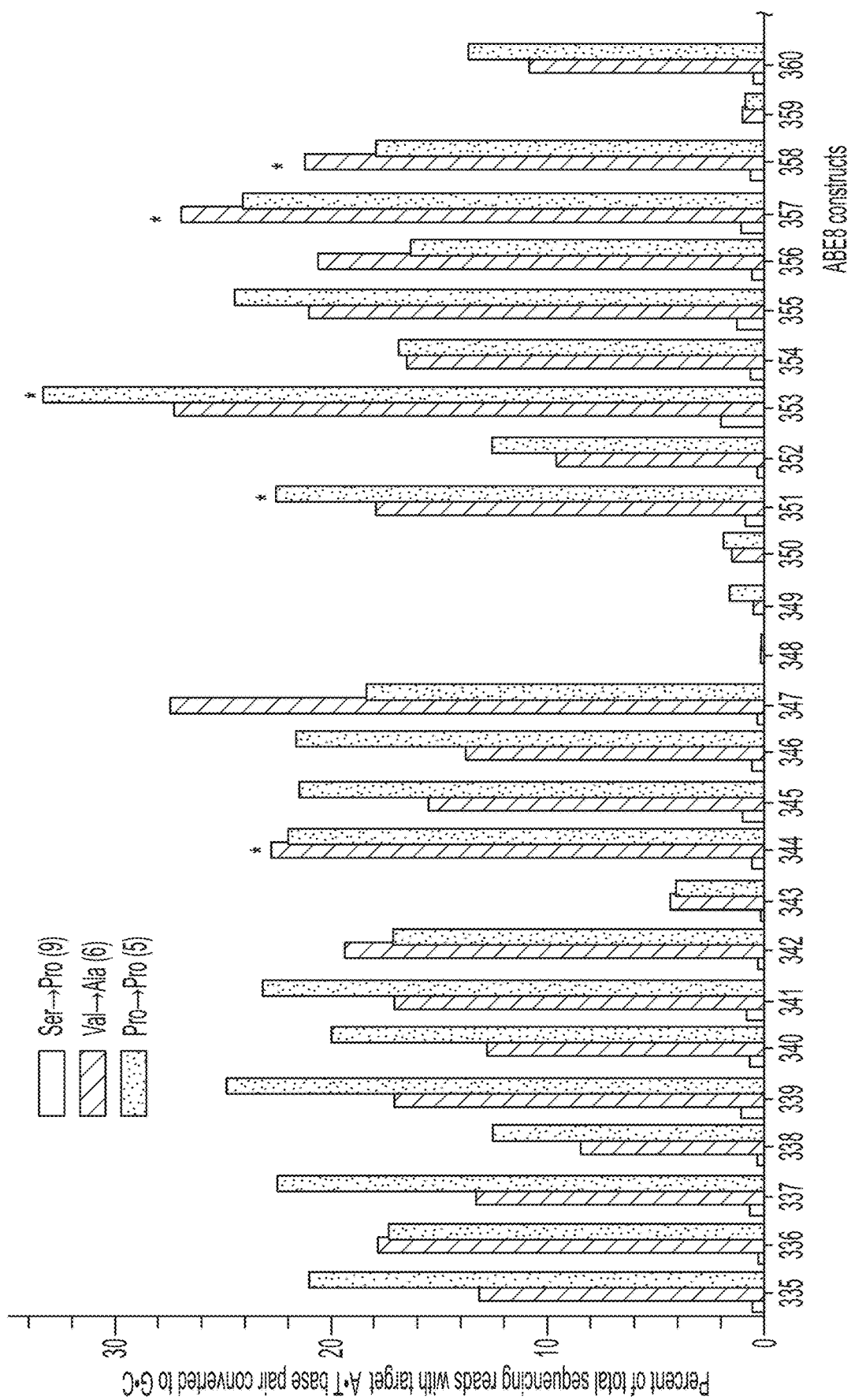
Figure 5:
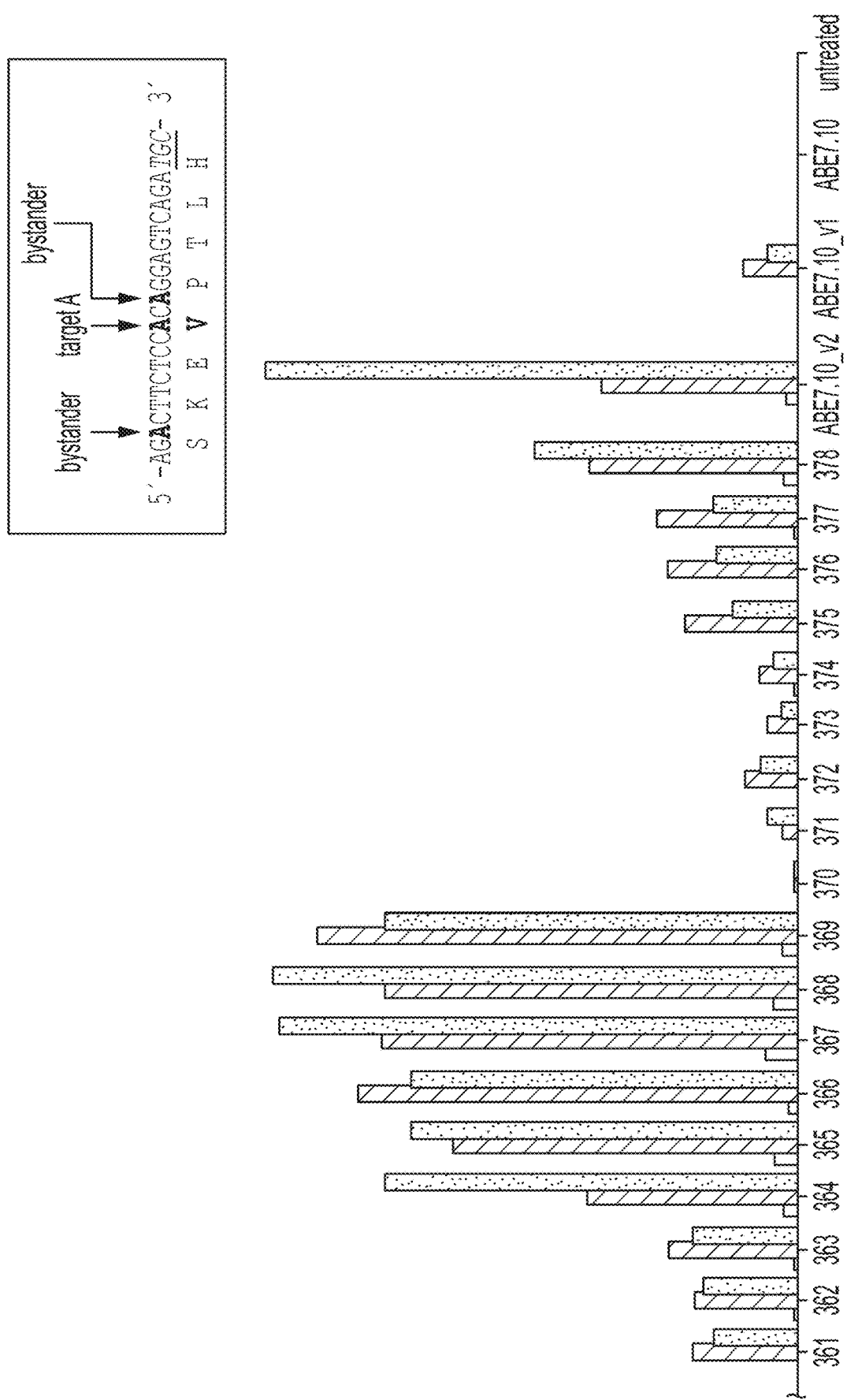

FIG. 5 is a graph illustrating the efficiency and specificity of ABE8s. The percent editing at intended target nucleotides and unintended target nucleotides (bystanders) is quantified. FIG. 5 discloses SEQ ID NOS 299-300, respectively, in order of appearance.

Figure 6:
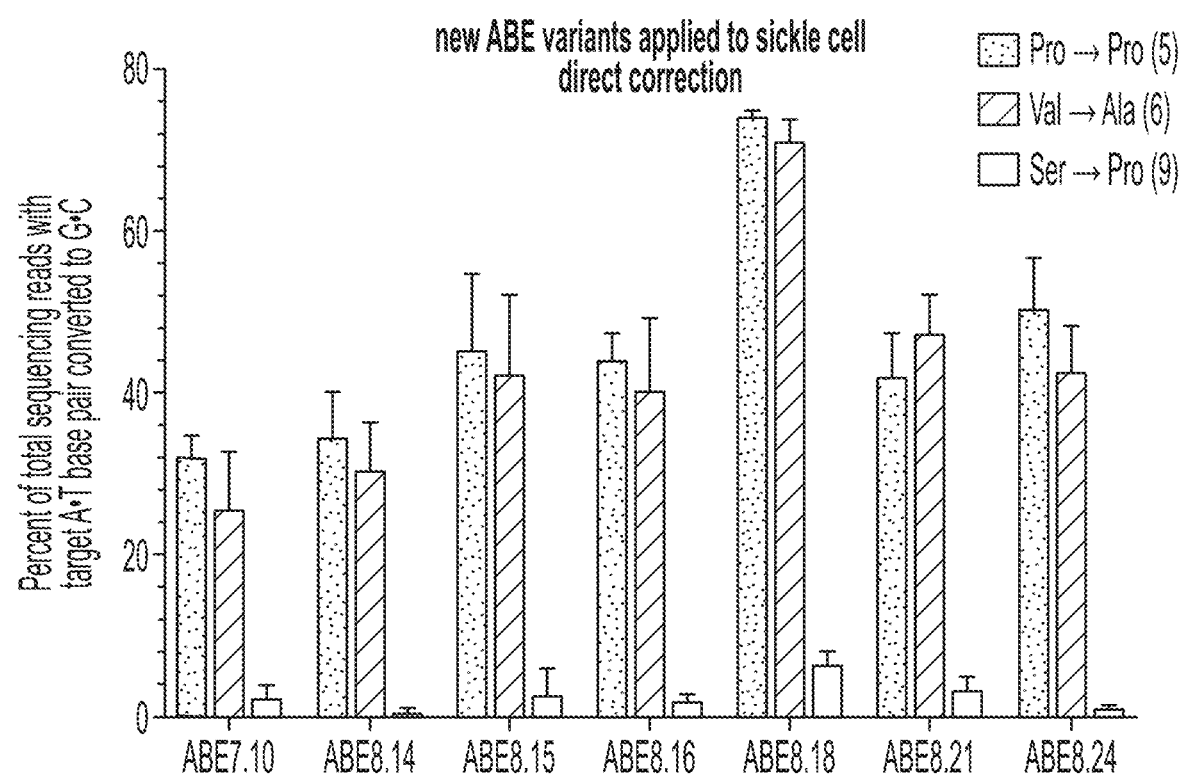

FIG. 6 is a graph illustrating the efficiency and specificity of ABE8s. The percent editing at intended target nucleotides and unintended target nucleotides (bystanders) is quantified.

Figure 7A:
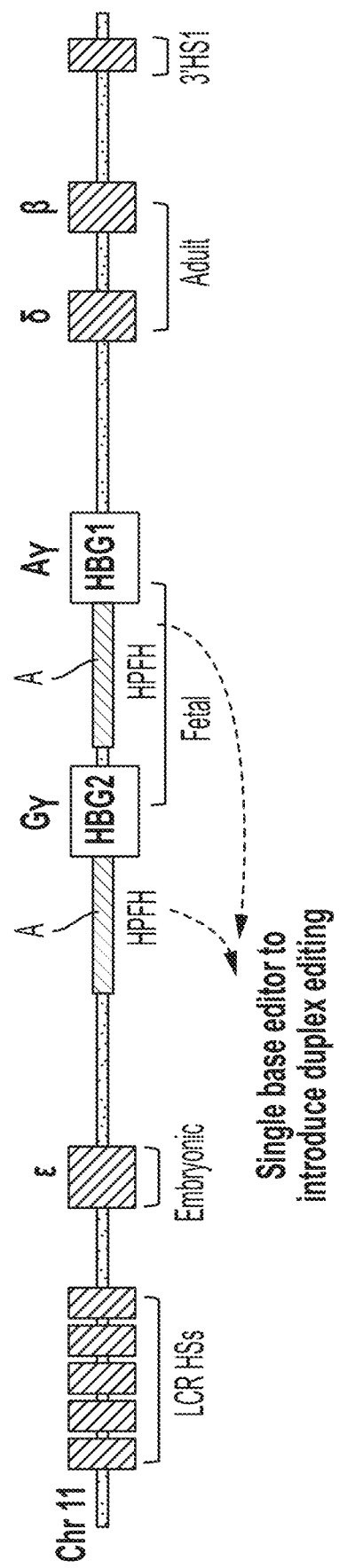
Figure 7B:
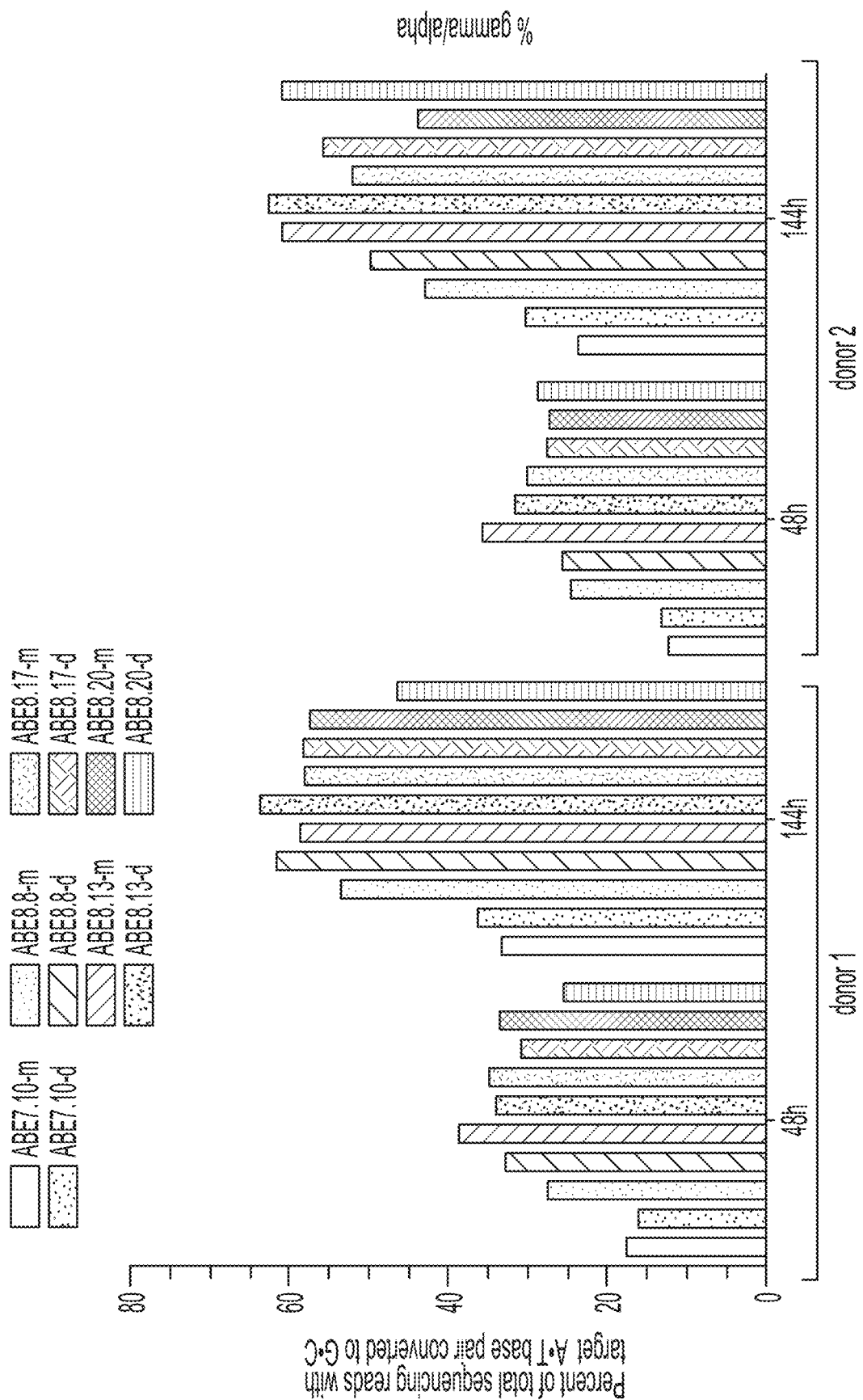
Figure 7C:
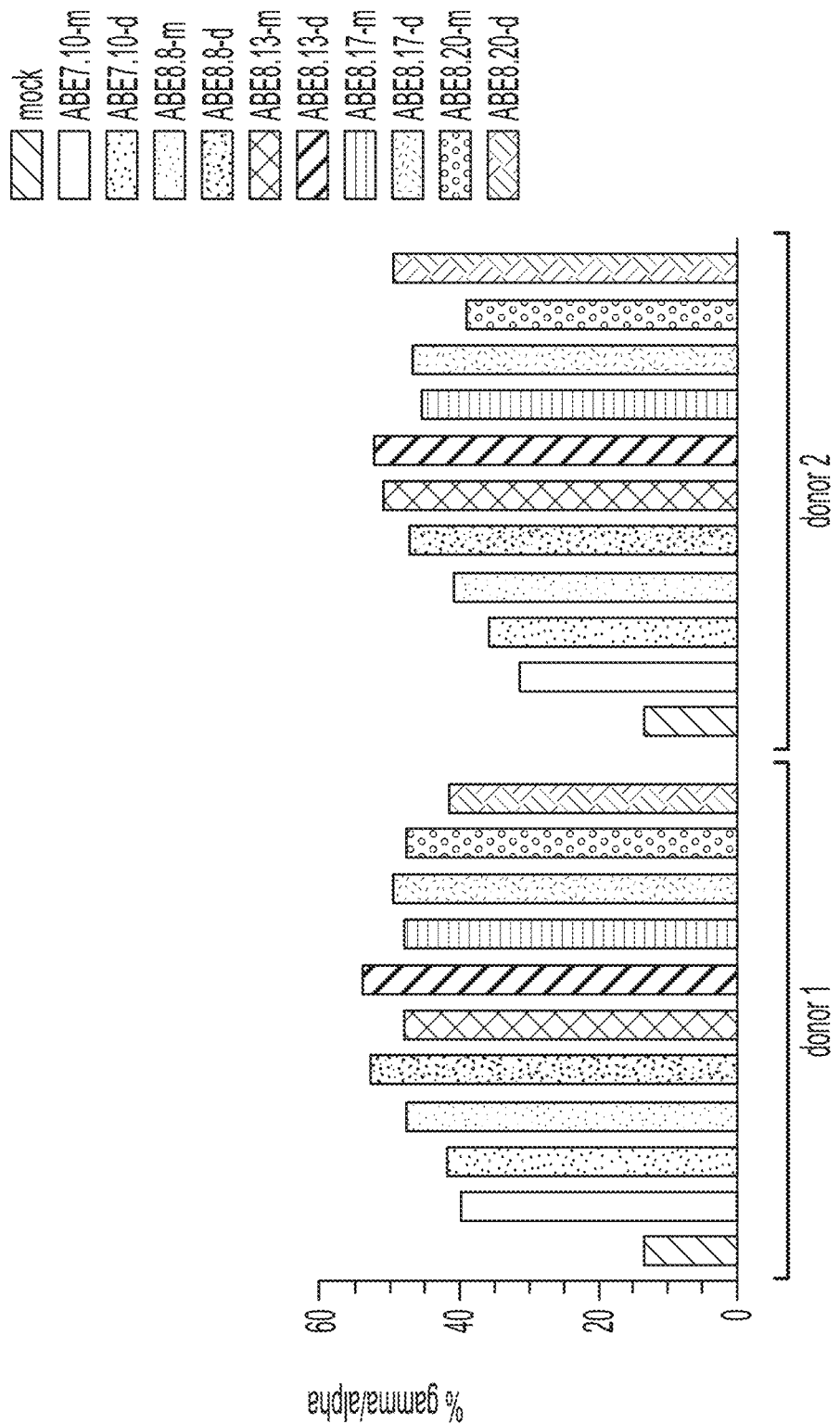

FIGS. 7A-7C depict a schematic and bar graphs related to A•T to G•C conversion and phenotypic outcomes in primary cells. FIG. 7A presents a schematic drawing of embryonic, fetal and adult globin genes situated on chromosome 11 and indicates the HBG1/2 HPFH sites at which a single base editor introduces duplex editing. FIG. 7B is a graph depicting DNA editing efficiency in CD34+ cells. Shown is A•T to G•C conversion at the −198 HBG1/2 promoter site in CD34+ cells treated with ABE from two separate donors. NGS analysis conducted at 48 and 144h post treatment. The −198 HBG1/2 target sequence is as follows: GTGGGG A7AGGGGCCCCCAAGAGG (SEQ ID NO: 76) with A7 in bold and double-underline. Percent A•T to G•C plotted for A7. FIG. 7C is a graph reflecting percent γ-globin/α-globin expression in erythrocytes derived from ABE-edited cells. Shown in FIG. 7C is the percentage of γ-globin formed as a fraction of alpha-globin. Values for FIGS. 7B and 7C are shown from two different donors, post ABE treatment and erythroid differentiation. As observed in FIG. 7B, ABE8 editing efficiencies at the −198 HBG1/2 promoter target site were comparatively 2-3 times higher at early time points (48 hr). As observed in FIG. 7C, the ABE8 editing in CD34+ cells yielded an approximately 1.4-fold increase in γ-globin formation in differentiated erythrocytes. By way of example, the ABE8.13-d base editor resulted in 55% γ-globin/α-globin expression.

Figure 8A:
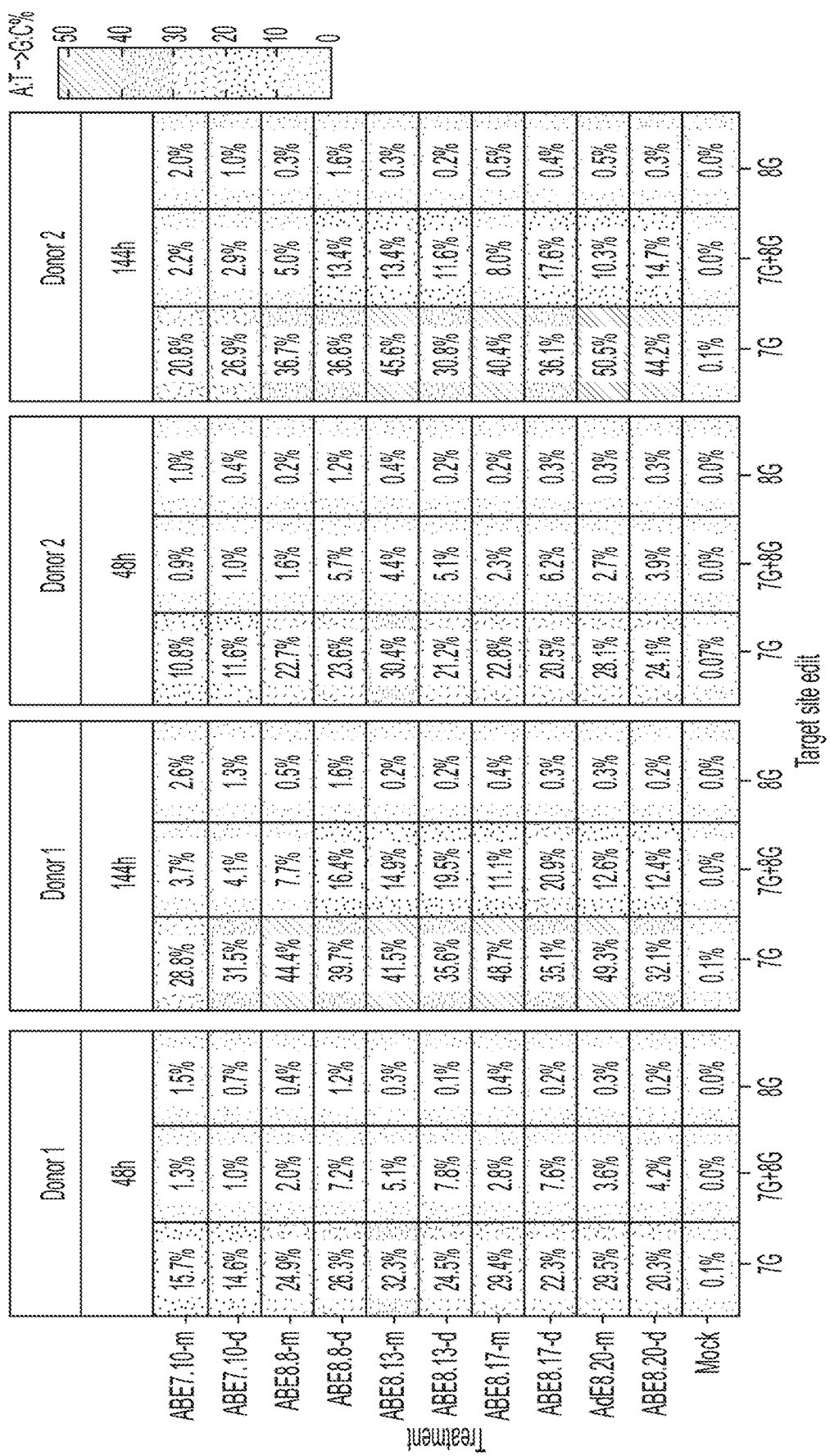
Figure 8B:
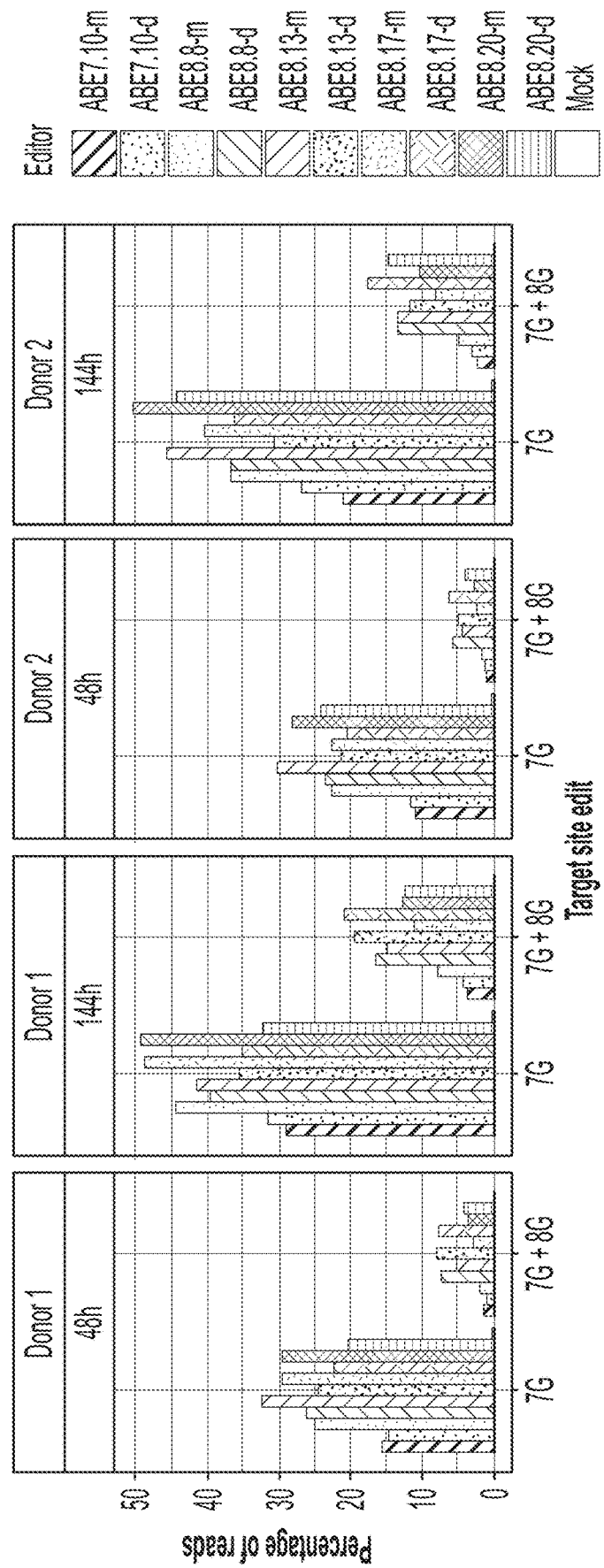

FIGS. 8A and 8B depict A•T to G•C conversion of CD34+ cells treated with ABE8 at the −198 promoter site upstream of HBG1/2. FIG. 8A is a heat map depicting A to G editing frequency of ABE8s in CD34+ cells from two donors, where Donor 2 is heterozygous for sickle cell disease, at 48 and 144h post editor treatment. FIG. 8B is a graphical representation of distribution of total sequencing reads which contain either A7 only edits or combined (A7+A8) edits.

Figure 9:
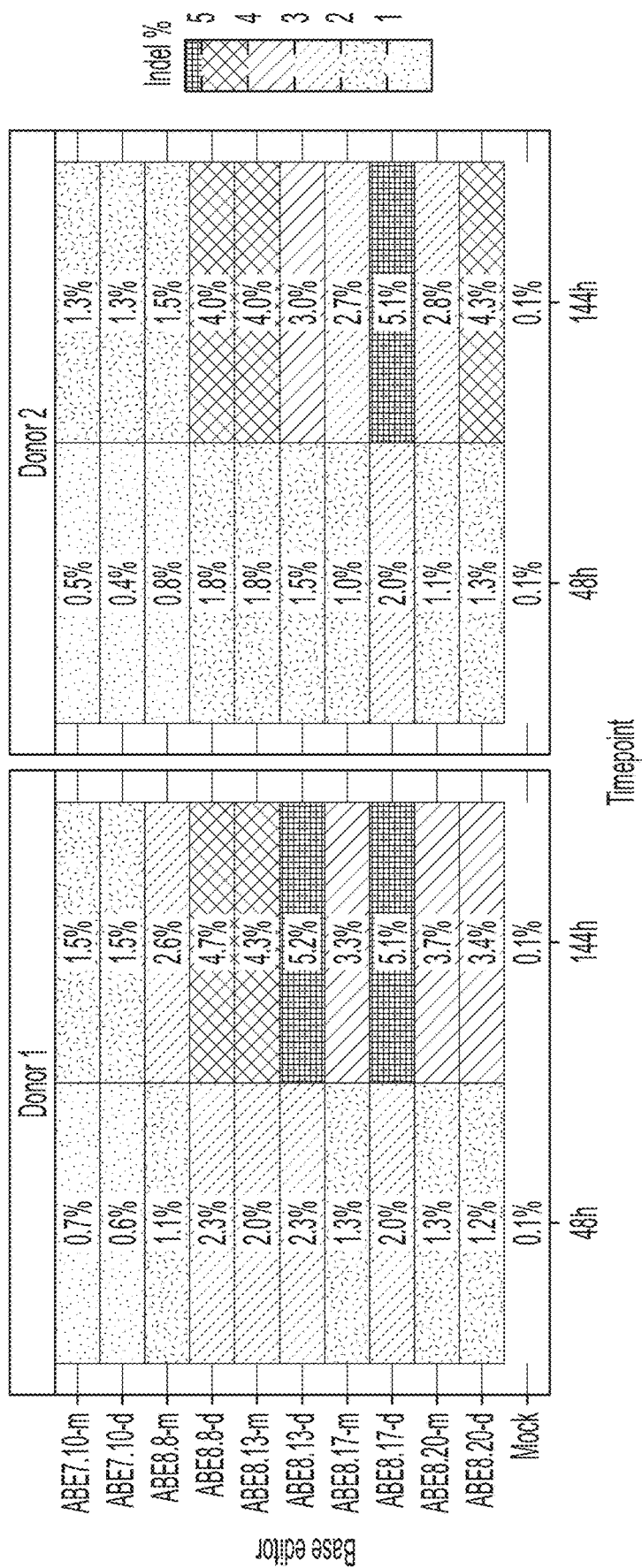

FIG. 9 is a heat map depicting INDEL frequency of CD34+ cells treated with ABE8 at the −198 site of the gamma-globin promoter. Frequencies shown from two donors at 48h and 144h time points. Complete A•T to G•C conversion at the HBG1/2-198 promoter target site as described herein creates a poly-G stretch of 10-nt. Because such homopolymer runs often increase the rate of PCR- and sequencing-induced errors, elevated INDEL frequencies are observed at this site.

Figure 10:
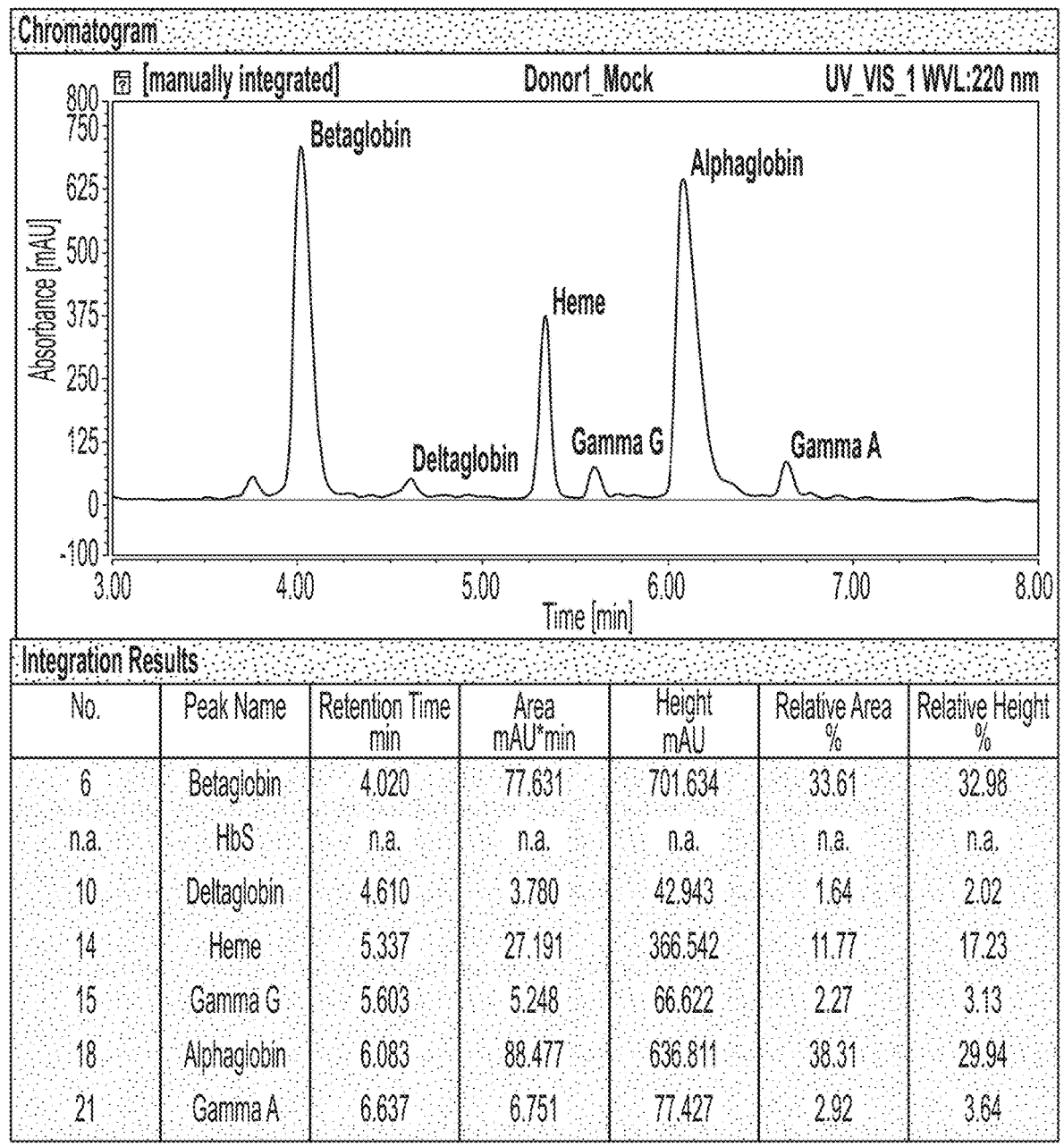

FIG. 10 depicts an ultra-high performance liquid chromatography (UHPLC) UV-Vis trace (220 nm) and integration of globin chain levels of untreated differentiated CD34+ cells (donor 1).

Figure 11:
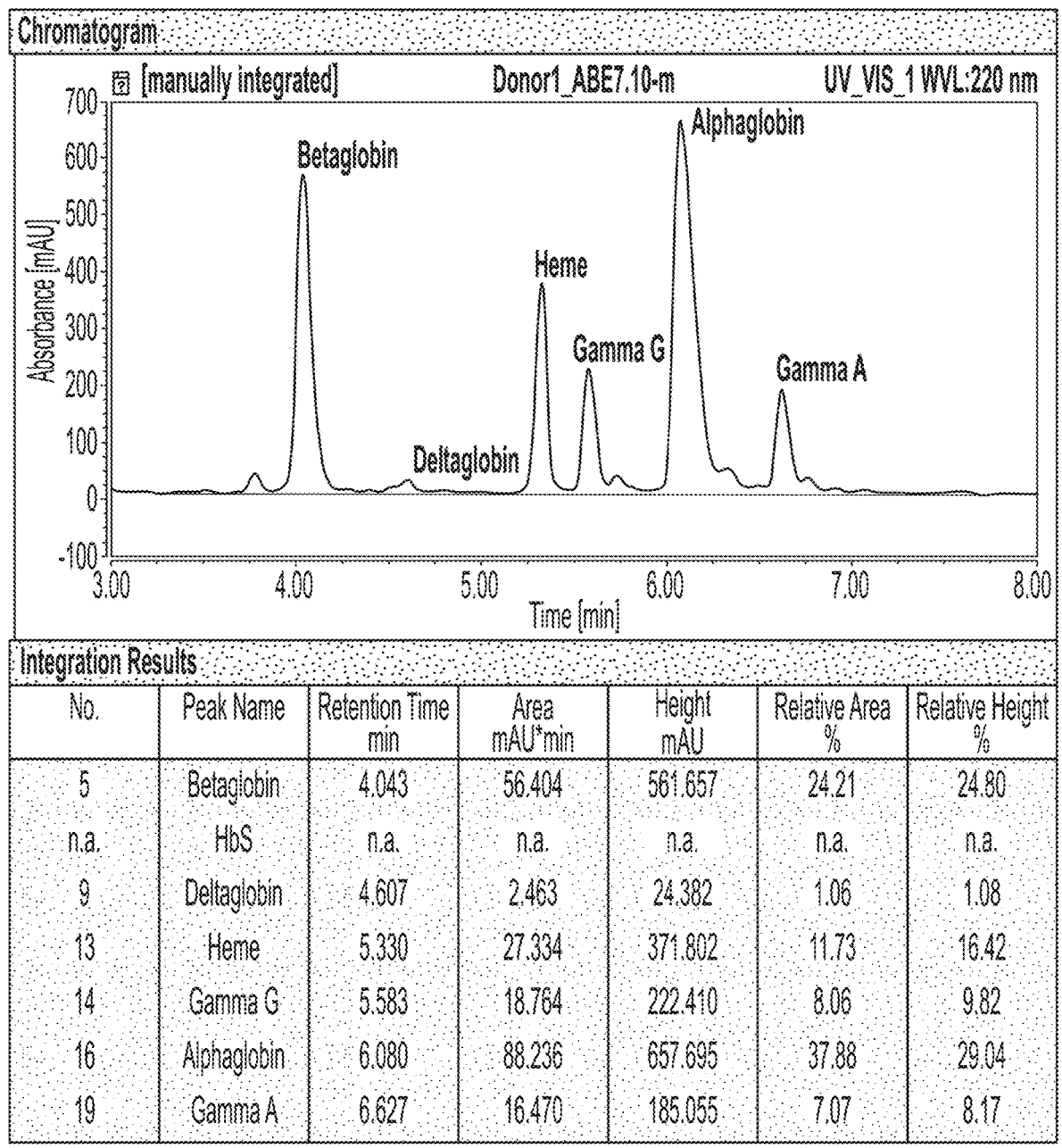

FIG. 11 depicts an UHPLC UV-Vis trace (220 nm) and integration of globin chain levels of differentiated CD34+ cells treated with ABE7.10-m (donor 1)

Figure 12:
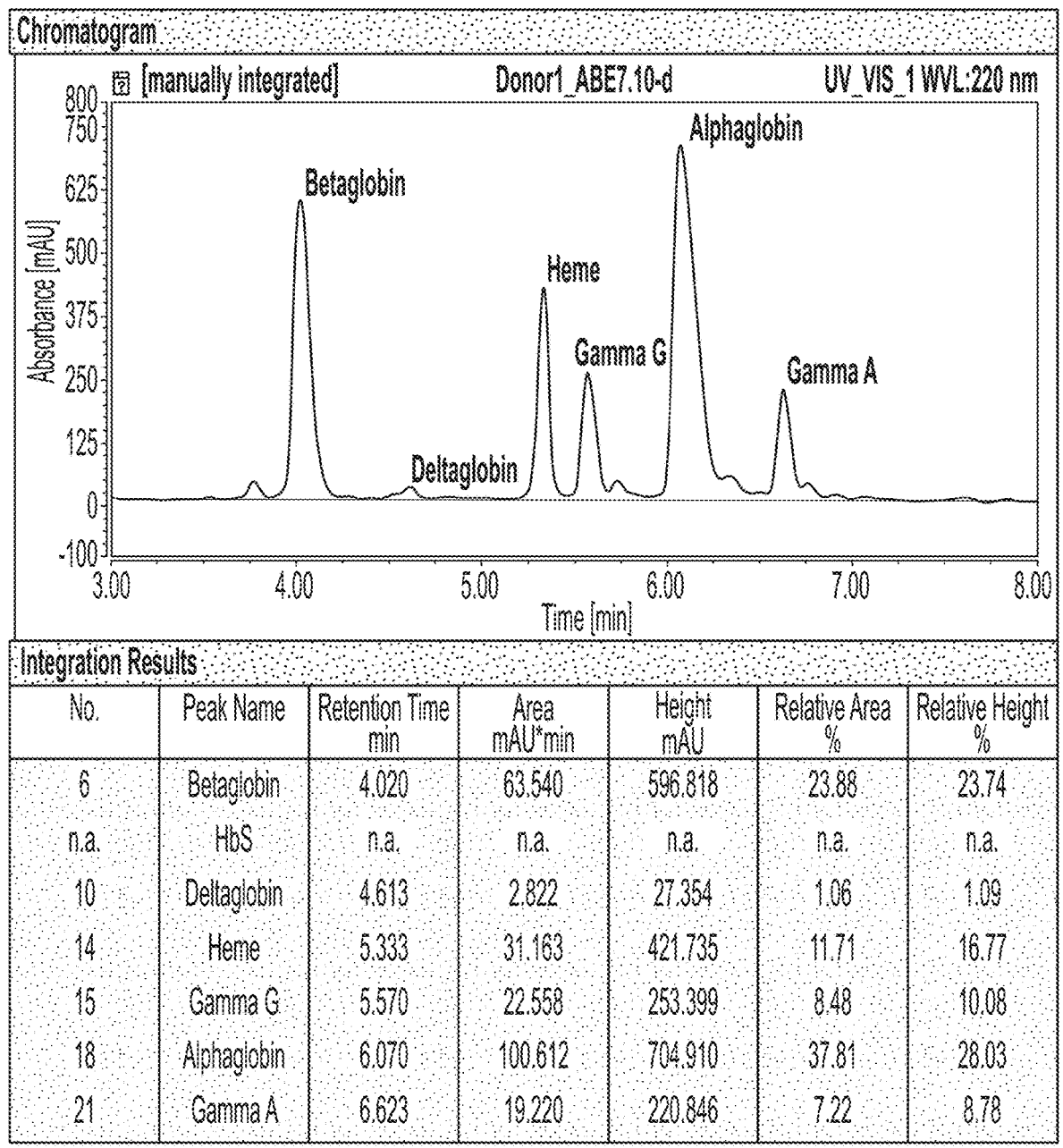

FIG. 12 depicts an UHPLC UV-Vis trace (220 nm) and integration of globin chain levels of differentiated CD34+ cells treated with ABE7.10-d (donor 1).

Figure 13:
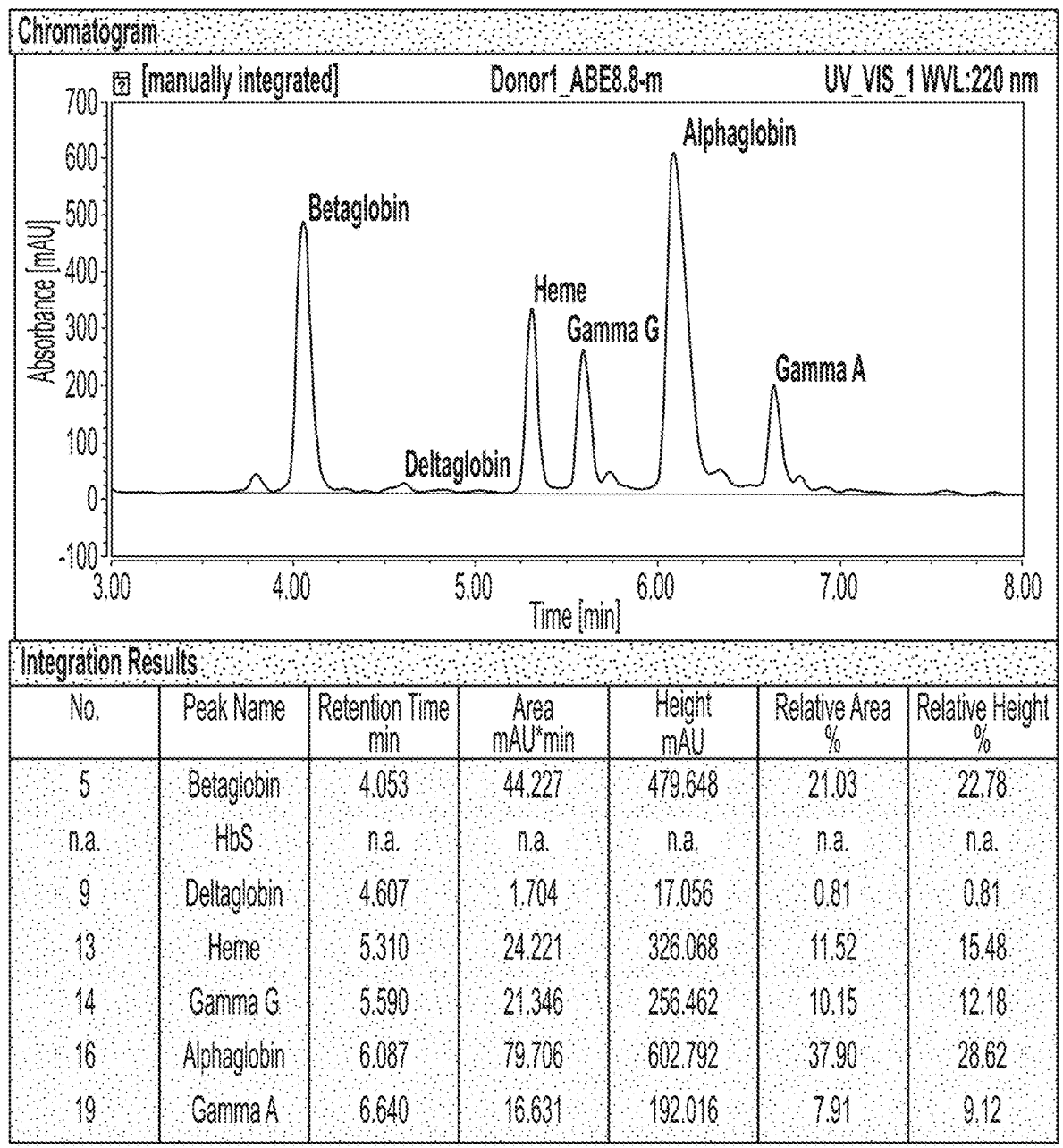
Figure 14:
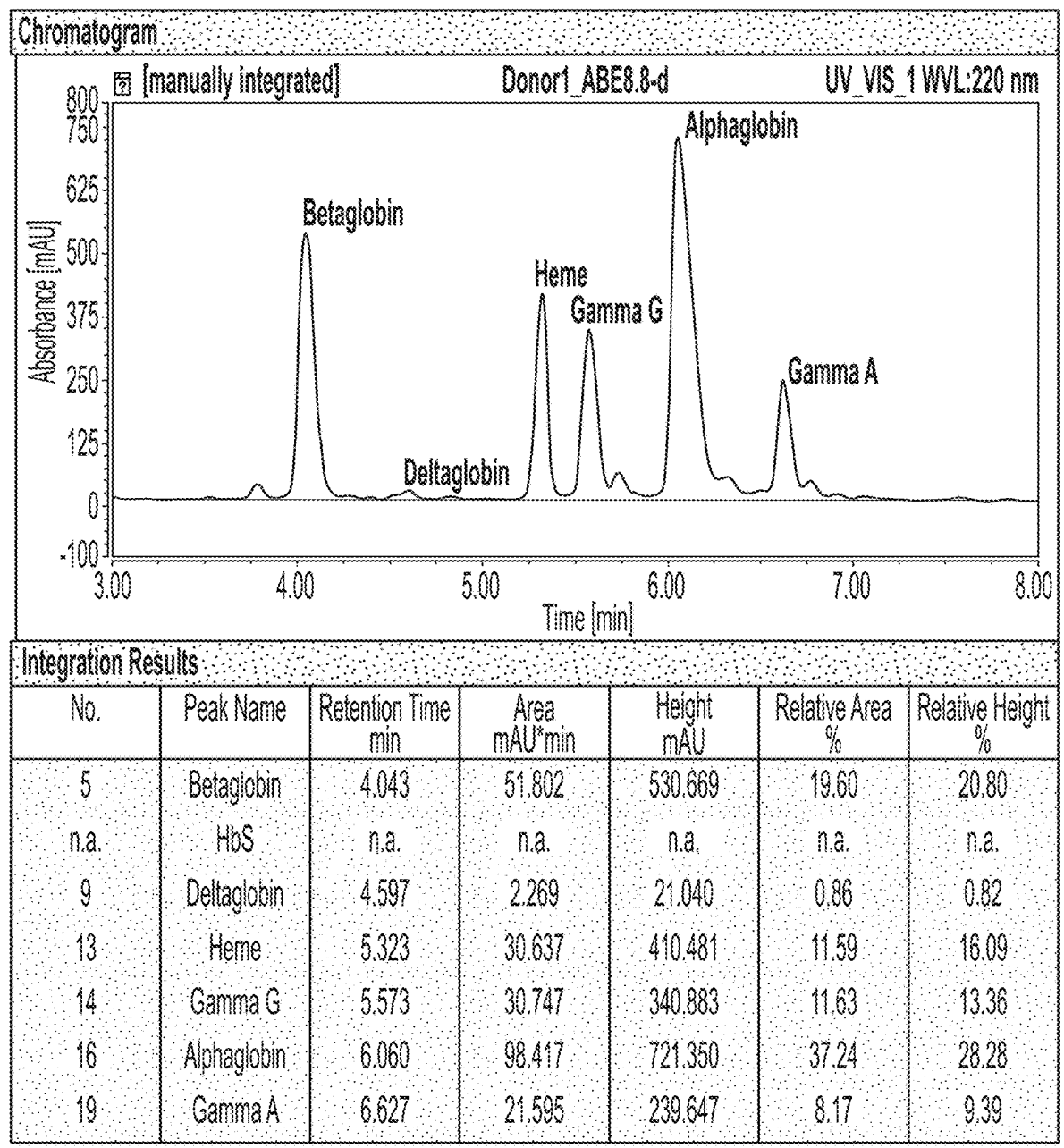

FIG. 13 depicts an UHPLC UV-Vis trace (220 nm) and integration of globin chain levels of differentiated CD34+ cells treated with ABE8.8-m (donor 1) FIG. 14 depicts an UHPLC UV-Vis trace (220 nm) and integration of globin chain levels of differentiated CD34+ cells treated with ABE8.8-d (donor 1).

Figure 15:
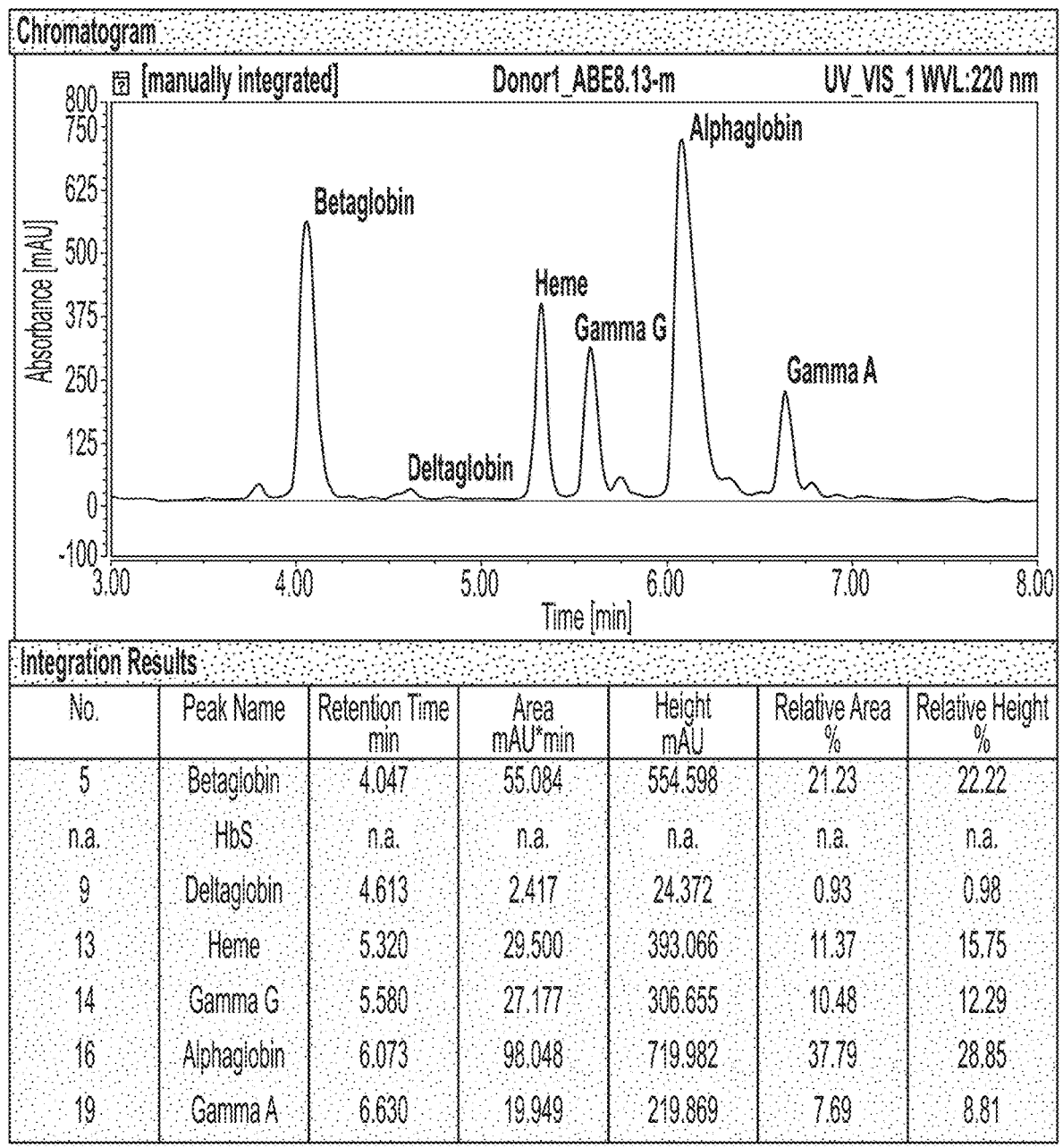

FIG. 15 depicts an UHPLC UV-Vis trace (220 nm) and integration of globin chain levels of differentiated CD34+ cells treated with ABE8.13-m (donor 1).

Figure 16:
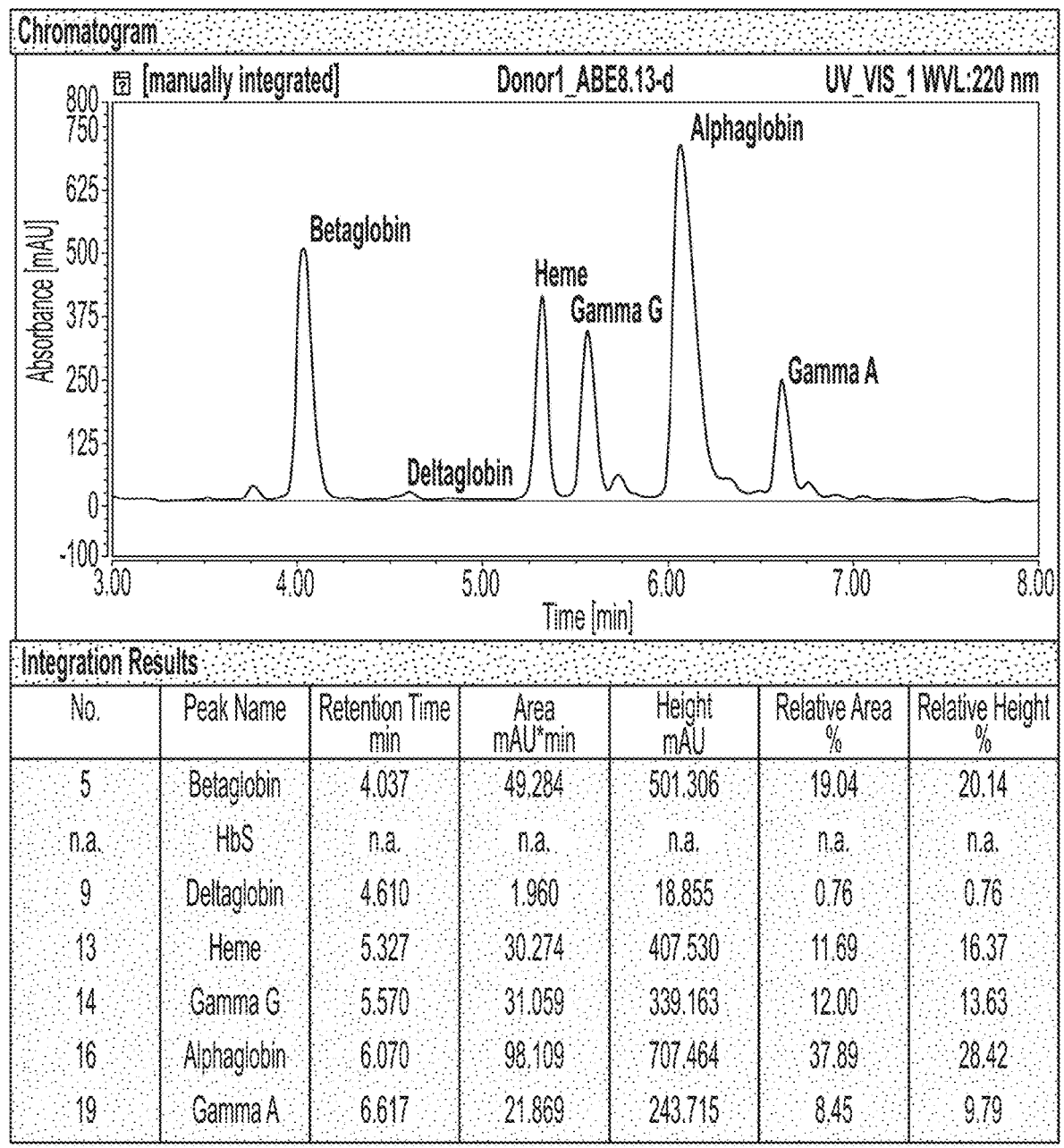

FIG. 16 depicts an UHPLC UV-Vis trace (220 nm) and integration of globin chain levels of differentiated CD34+ cells treated with ABE8.13-d (donor 1).

Figure 17:
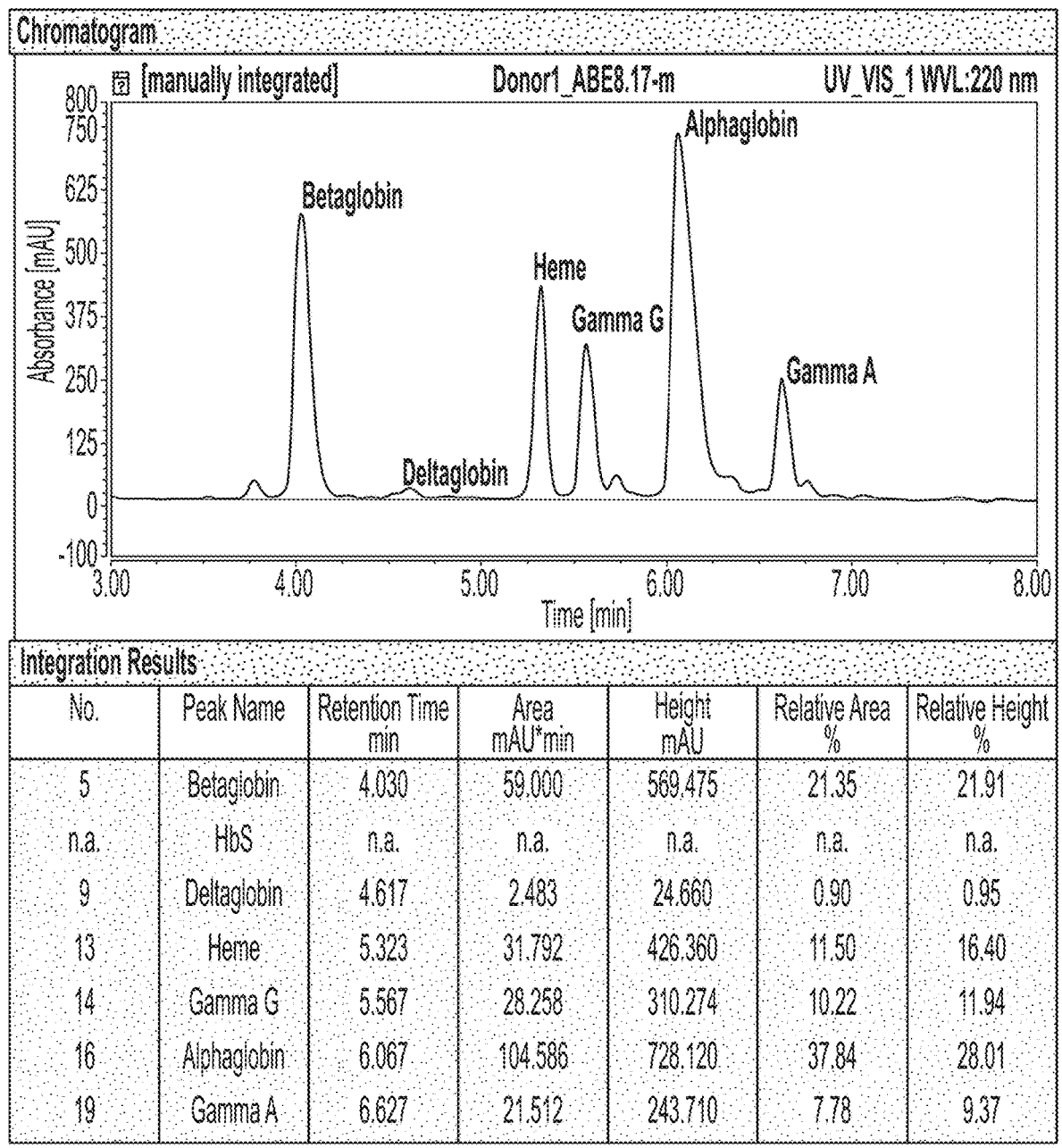

FIG. 17 depicts an UHPLC UV-Vis trace (220 nm) and integration of globin chain levels of differentiated CD34+ cells treated with ABE8.17-m (donor 1).

Figure 18:
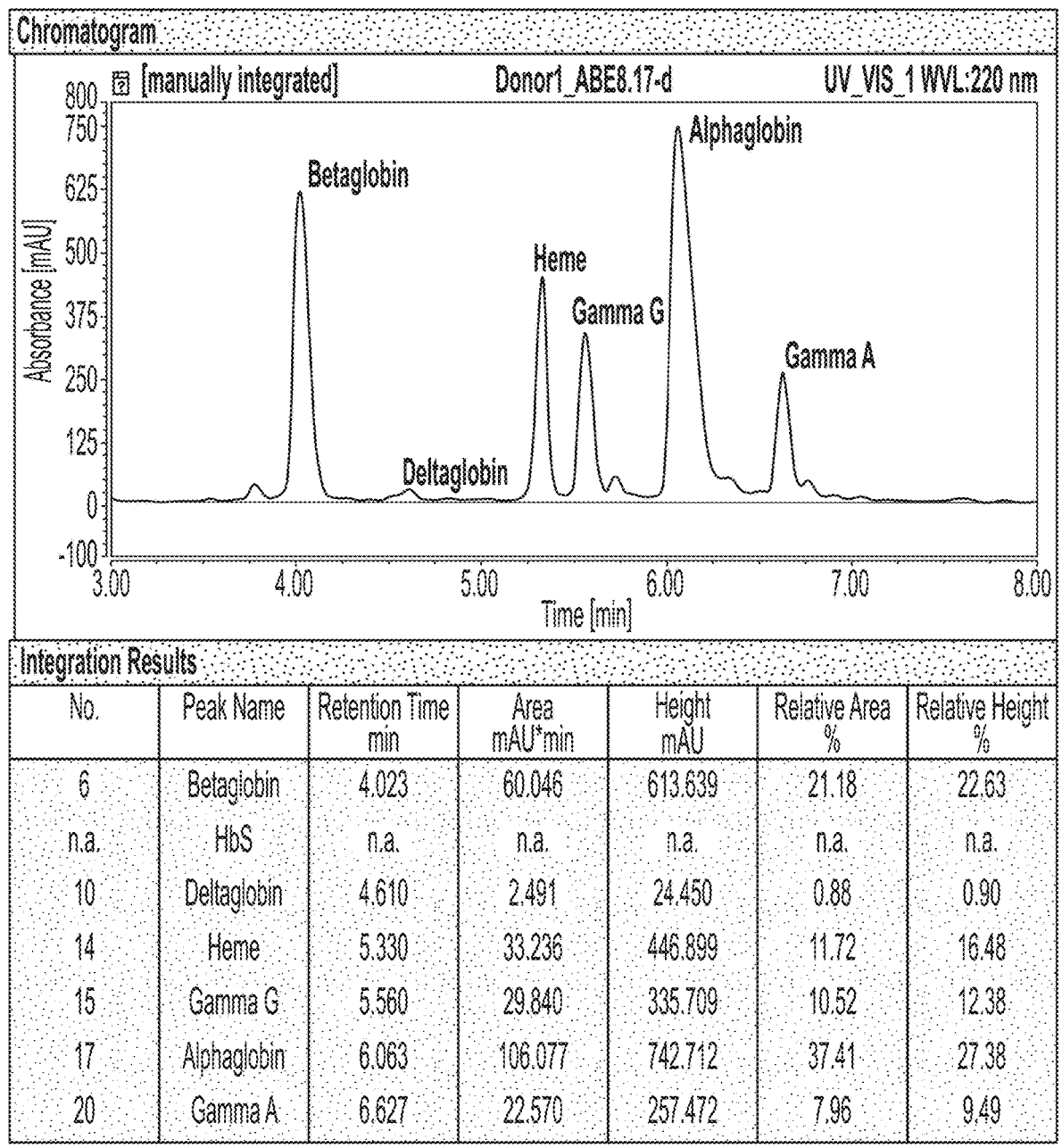

FIG. 18 depicts an UHPLC UV-Vis trace (220 nm) and integration of globin chain levels of differentiated CD34+ cells treated with ABE8.17-d (donor 1).

Figure 19:
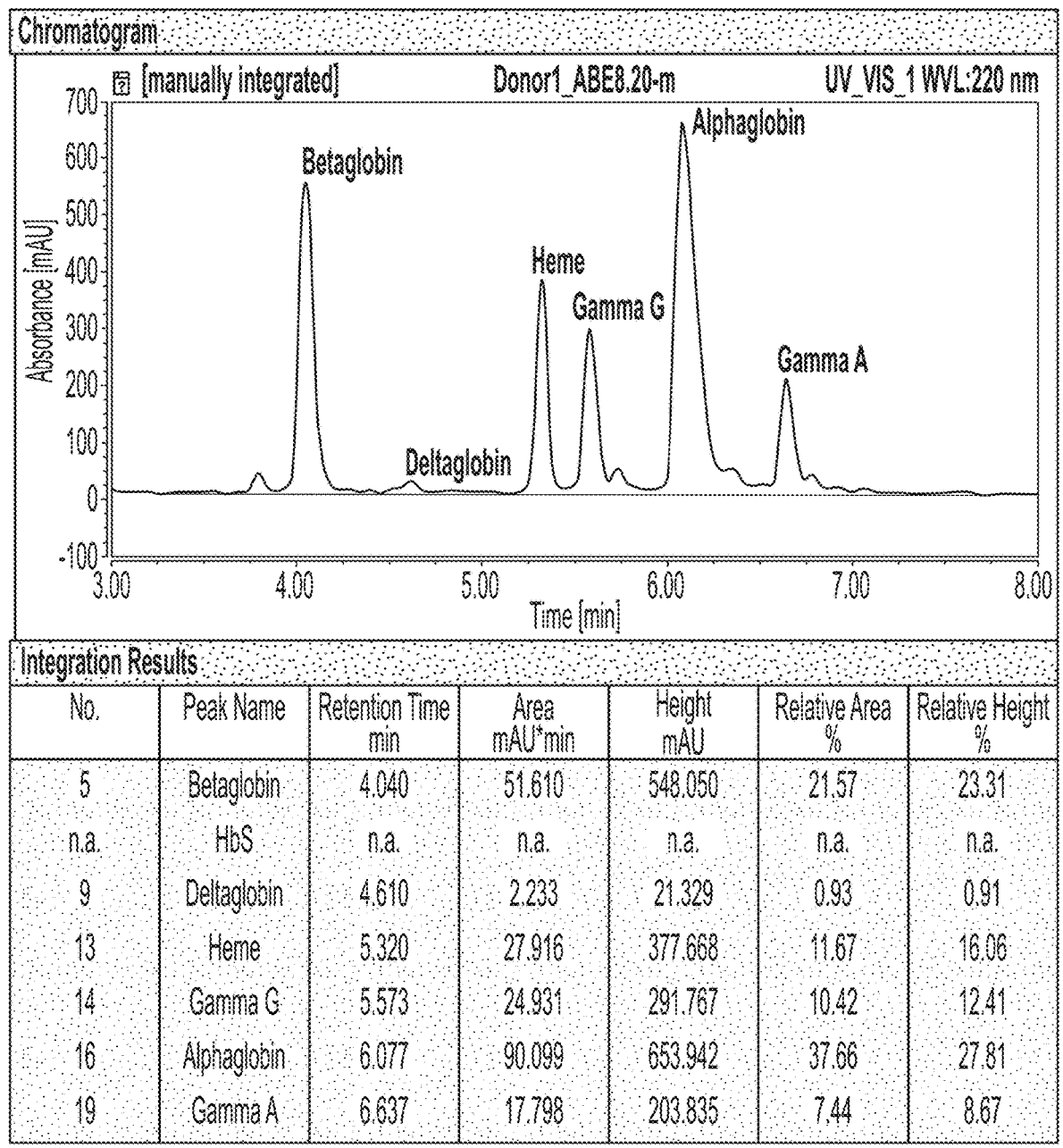

FIG. 19 depicts an UHPLC UV-Vis trace (220 nm) and integration of globin chain levels of differentiated CD34+ cells treated with ABE8.20-m (donor 1).

Figure 20:
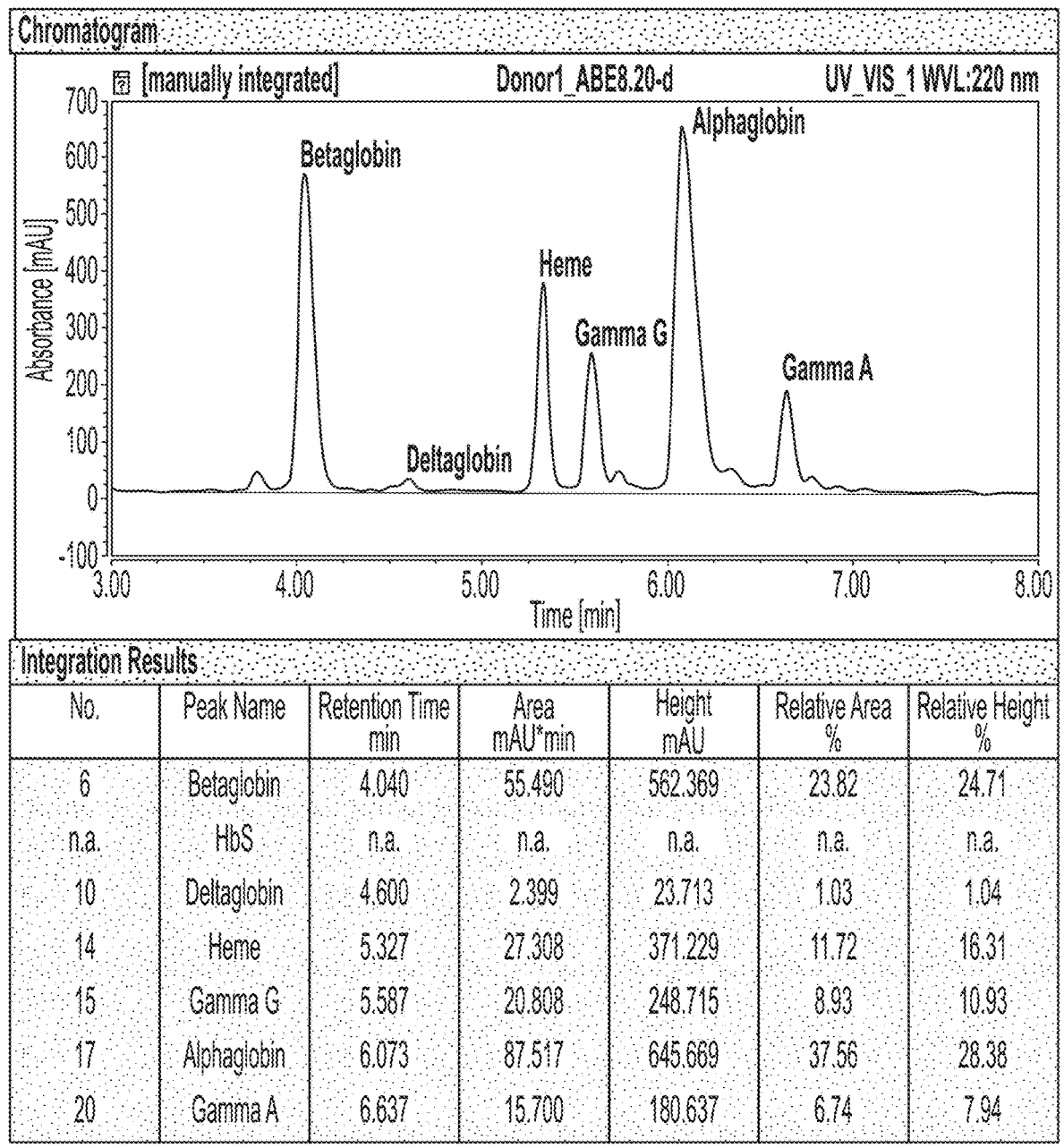

FIG. 20 depicts an UHPLC UV-Vis trace (220 nm) and integration of globin chain levels of differentiated CD34+ cells treated with ABE8.20-d (donor 1).

Figure 21:
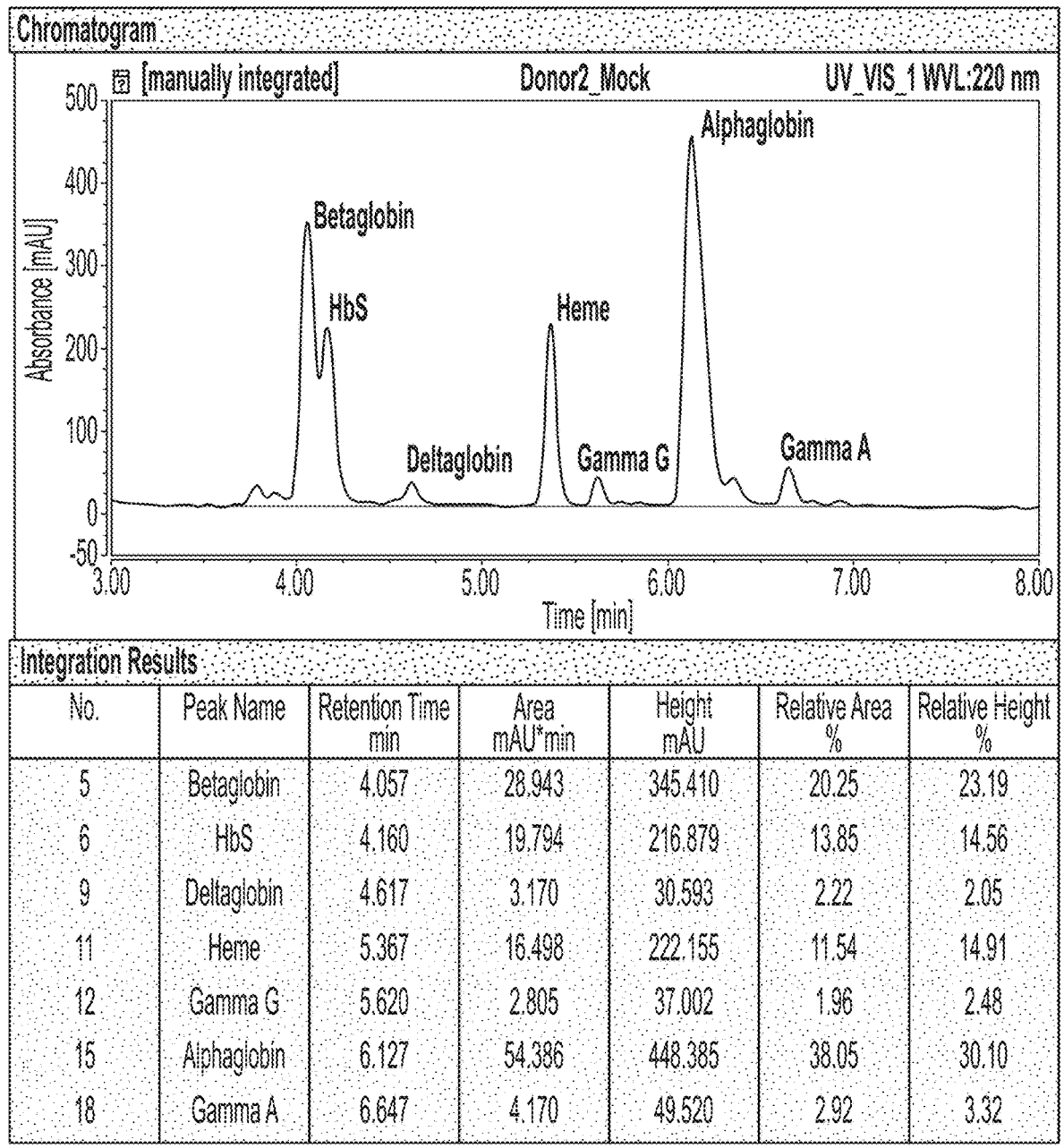

FIG. 21 depicts an UHPLC UV-Vis trace (220 nm) and integration of globin chain levels of differentiated CD34+ cells untreated (donor 2). Note: donor 2 is heterozygous for sickle cell disease.

Figure 22:
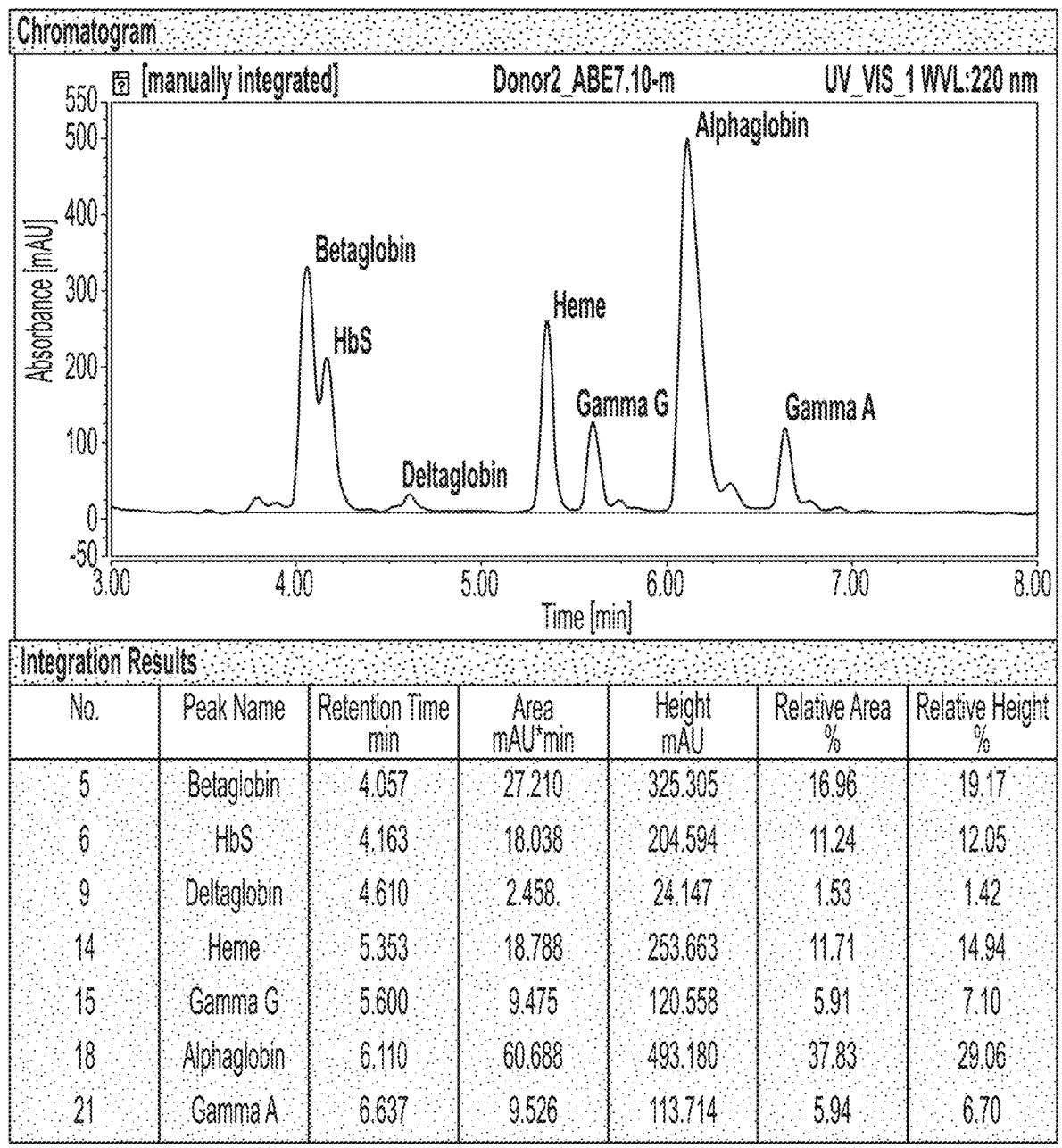

FIG. 22 depicts an UHPLC UV-Vis trace (220 nm) and integration of globin chain levels of differentiated CD34+ cells treated with ABE7.10-m (donor 2). Note: donor 2 is heterozygous for sickle cell disease.

Figure 23:
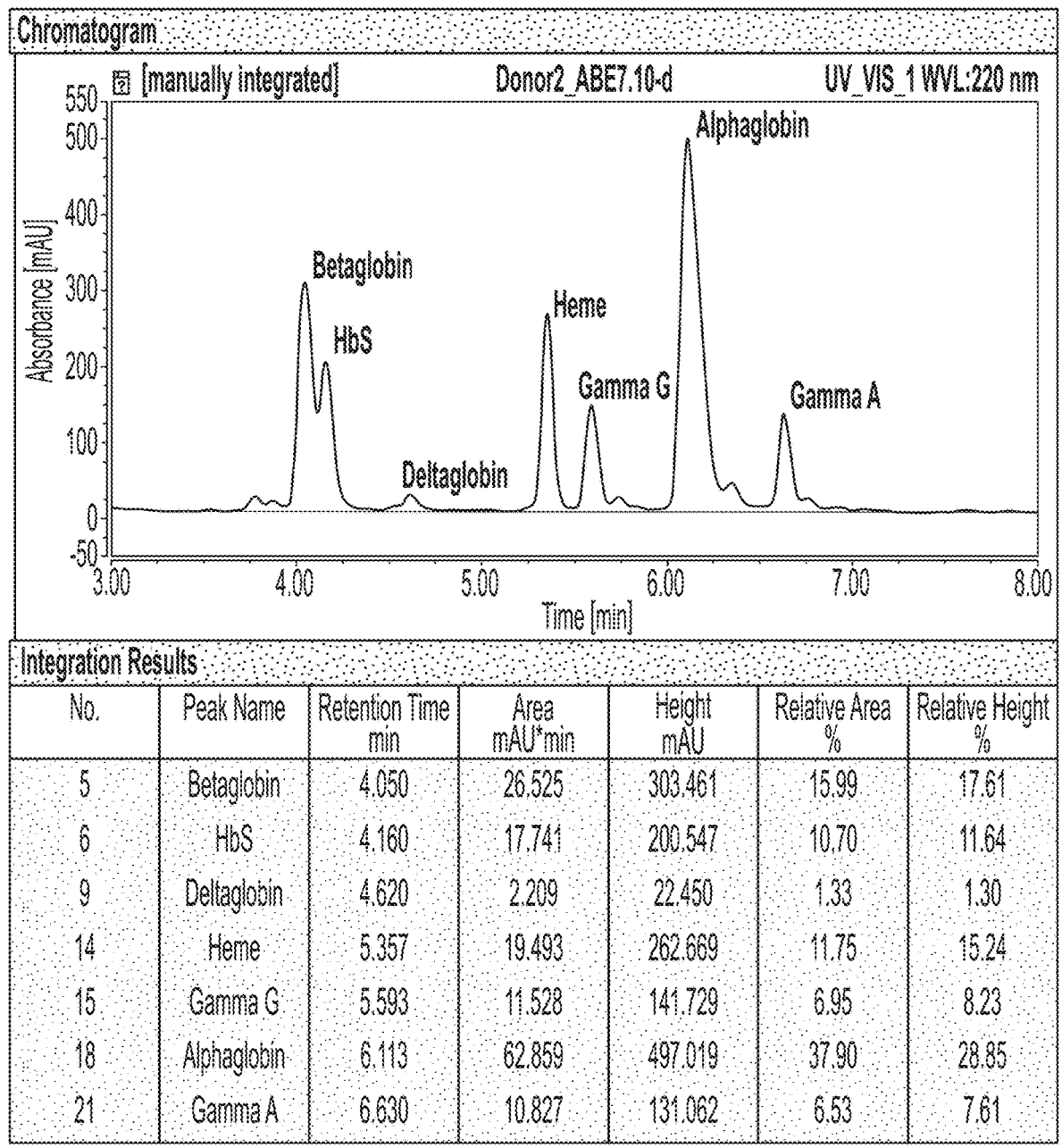

FIG. 23 depicts an UHPLC UV-Vis trace (220 nm) and integration of globin chain levels of differentiated CD34+ cells treated with ABE7.10-d (donor 2). Note: donor 2 is heterozygous for sickle cell disease.

Figure 24:
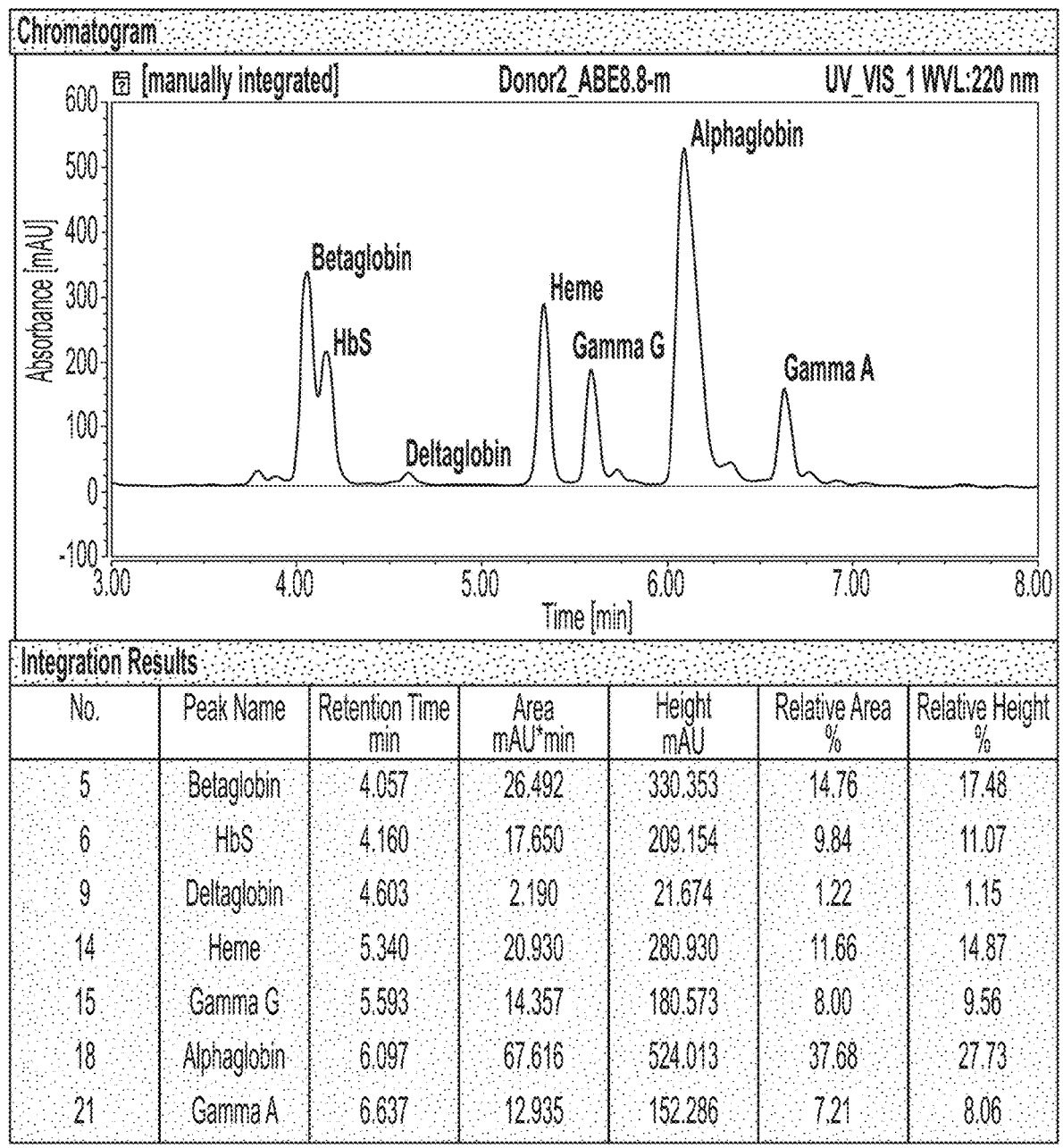

FIG. 24 depicts an UHPLC UV-Vis trace (220 nm) and integration of globin chain levels of differentiated CD34+ cells treated with ABE8.8-m (donor 2). Note: donor 2 is heterozygous for sickle cell disease.

Figure 25:
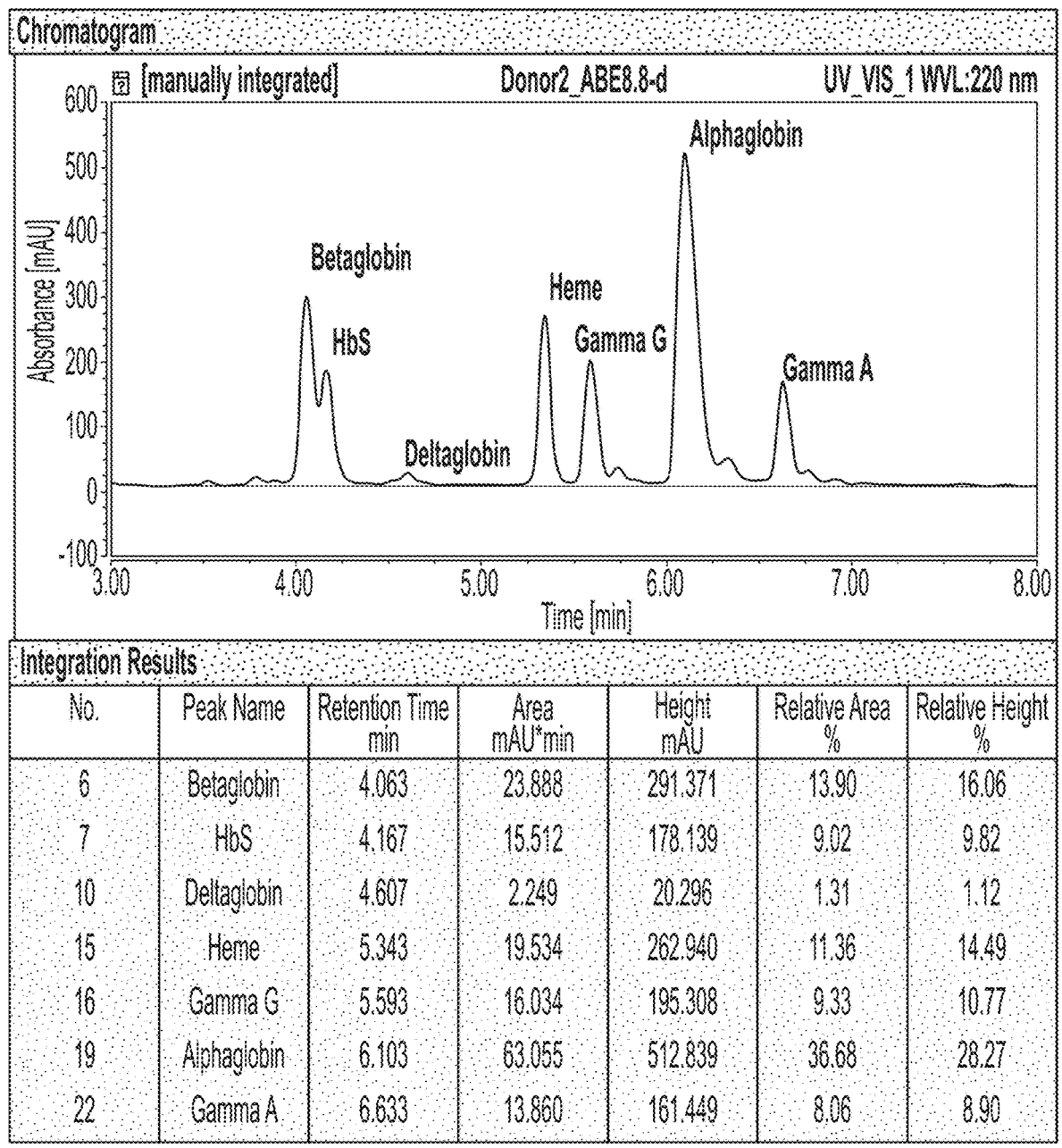

FIG. 25 depicts an UHPLC UV-Vis trace (220 nm) and integration of globin chain levels of differentiated CD34+ cells treated with ABE8.8-d (donor 2). Note: donor 2 is heterozygous for sickle cell disease.

Figure 26:
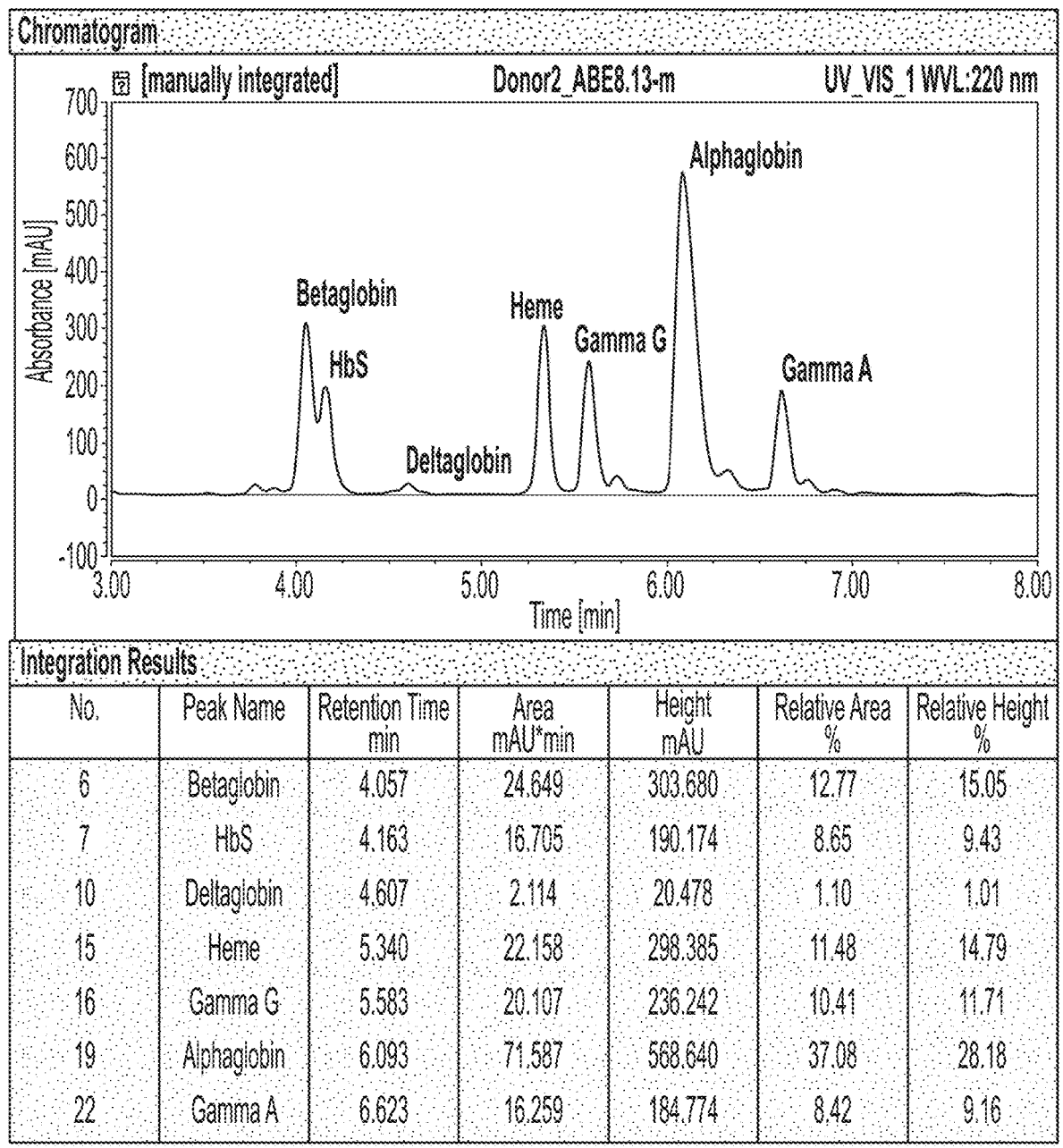

FIG. 26 depicts an UHPLC UV-Vis trace (220 nm) and integration of globin chain levels of differentiated CD34+ cells treated with ABE8.13-m (donor 2). Note: donor 2 is heterozygous for sickle cell disease.

Figure 27:
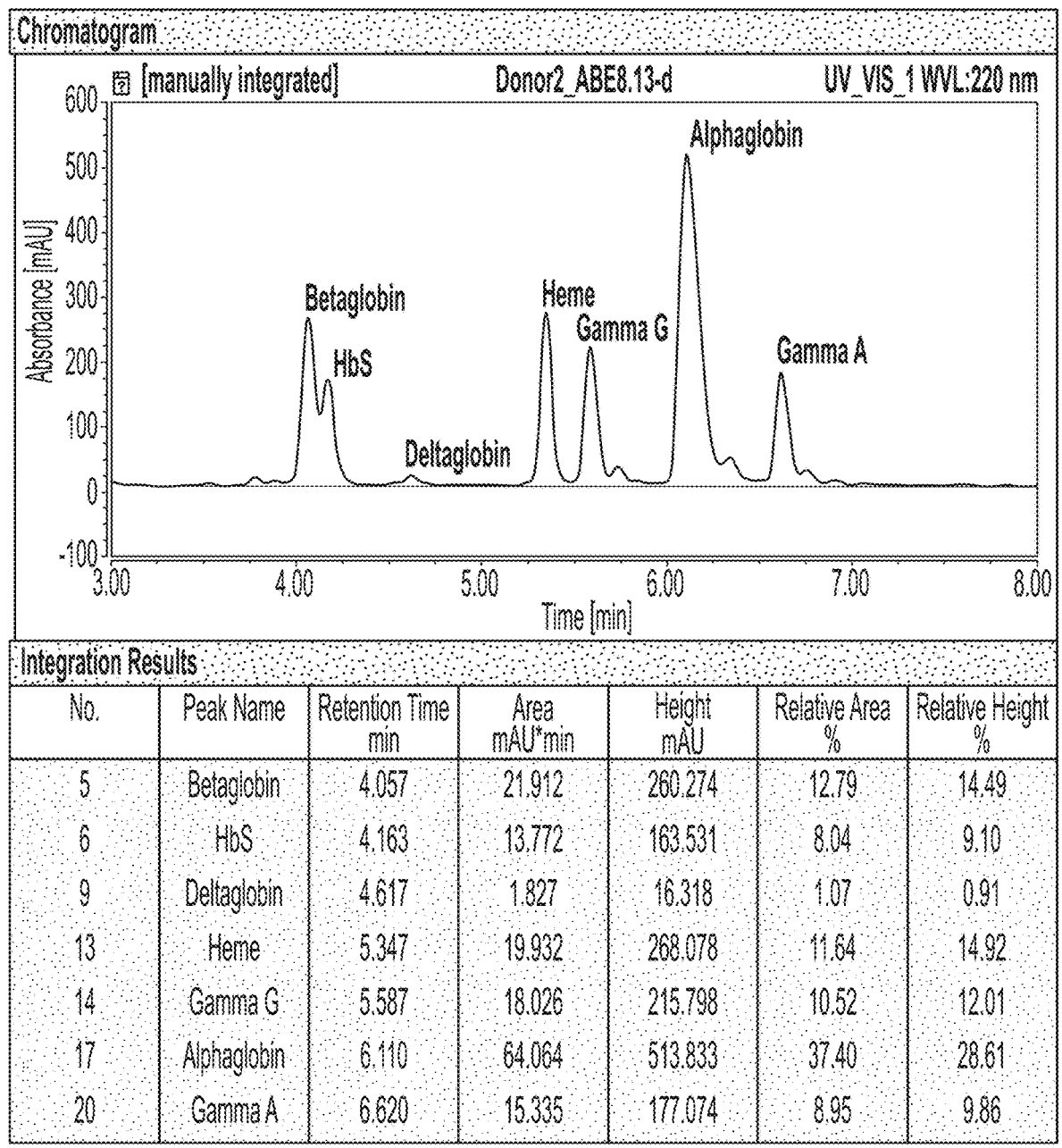

FIG. 27 depicts an UHPLC UV-Vis trace (220 nm) and integration of globin chain levels of differentiated CD34+ cells treated with ABE8.13-d (donor 2). Note: donor 2 is heterozygous for sickle cell disease.

Figure 28:
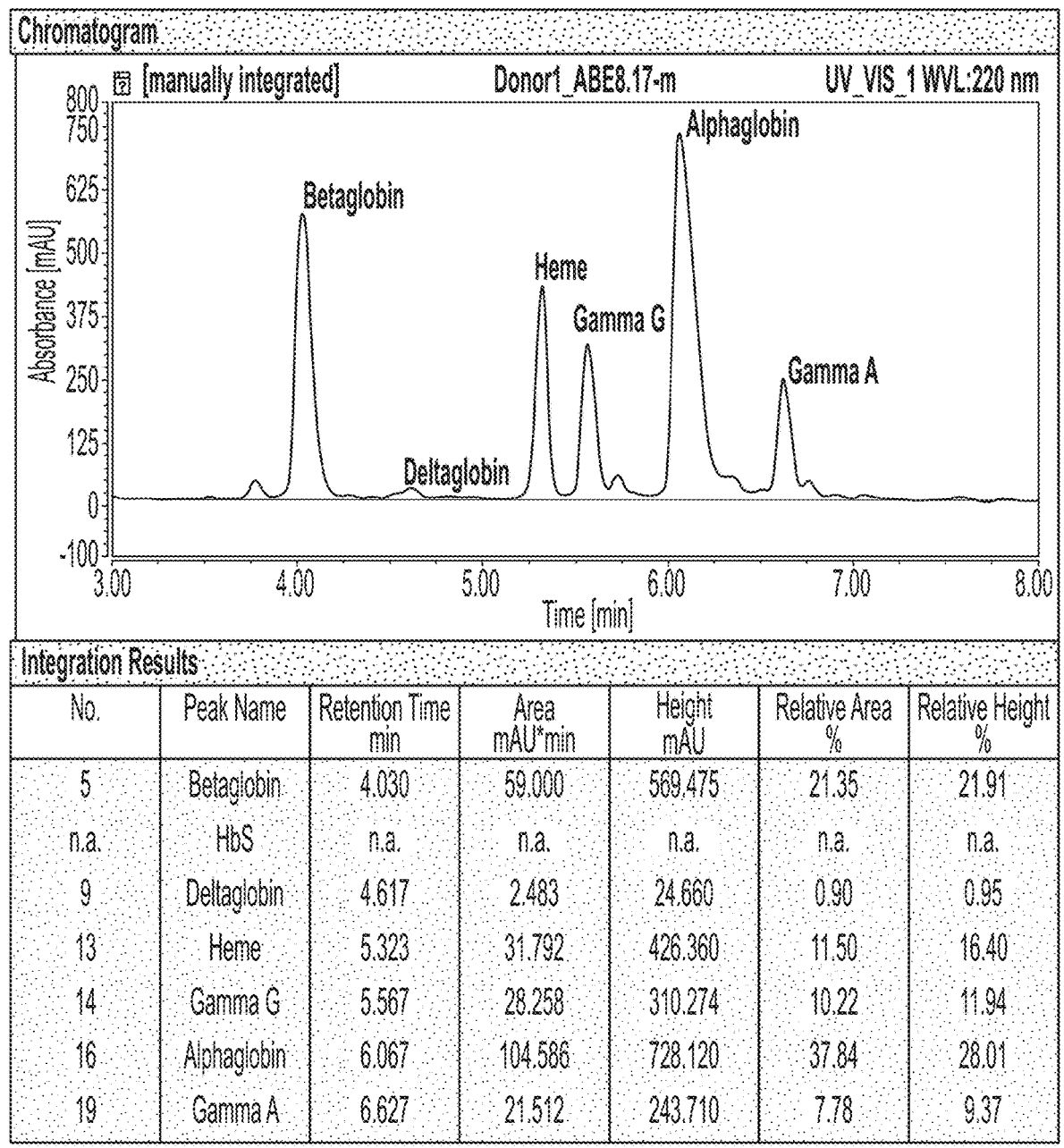

FIG. 28 depicts an UHPLC UV-Vis trace (220 nm) and integration of globin chain levels of differentiated CD34+ cells treated with ABE8.17-m (donor 1).

Figure 29:
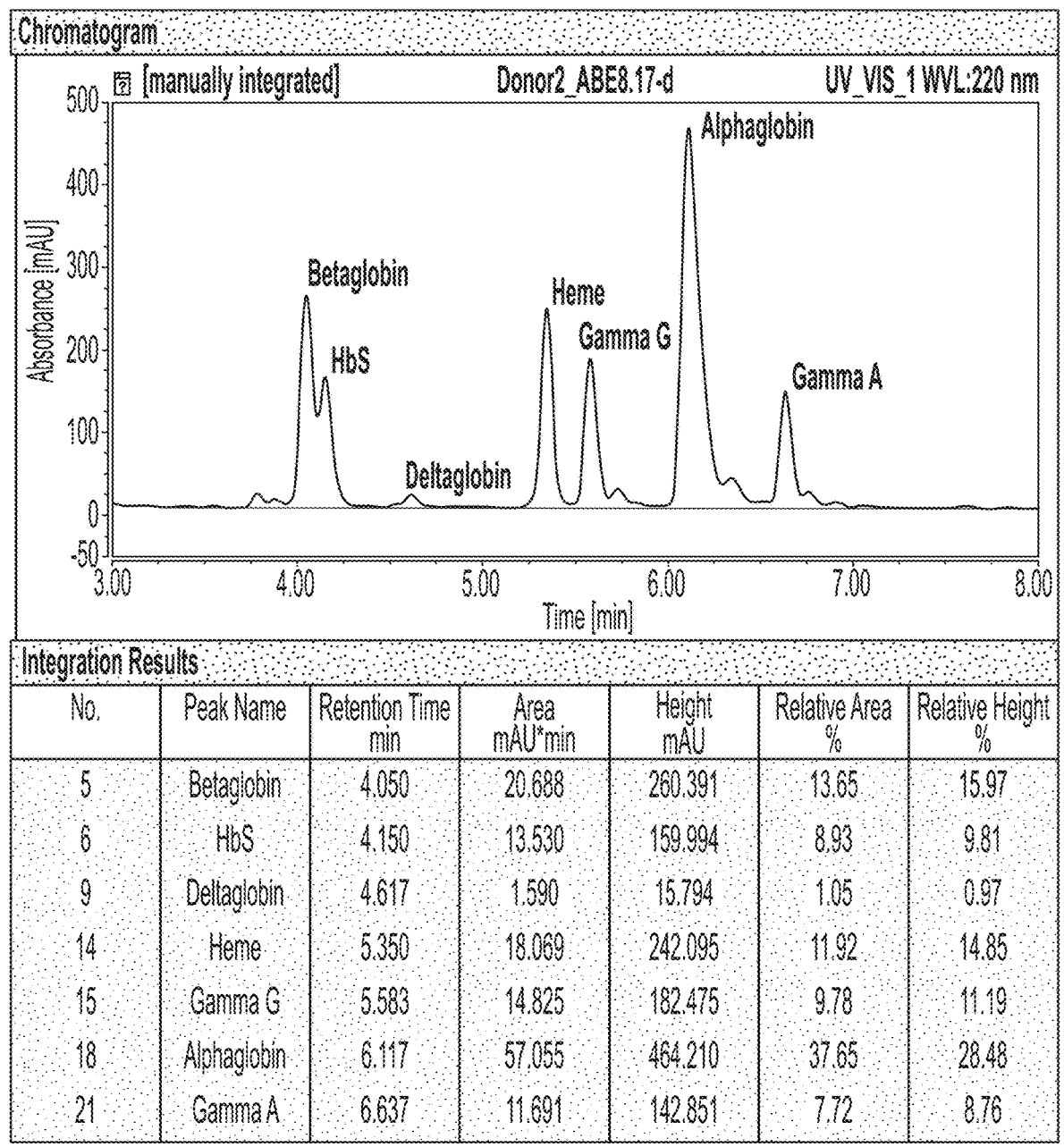

FIG. 29 depicts an UHPLC UV-Vis trace (220 nm) and integration of globin chain levels of differentiated CD34+ cells treated with ABE8.17-d (donor 2). Note: donor 2 is heterozygous for sickle cell disease.

Figure 30A:
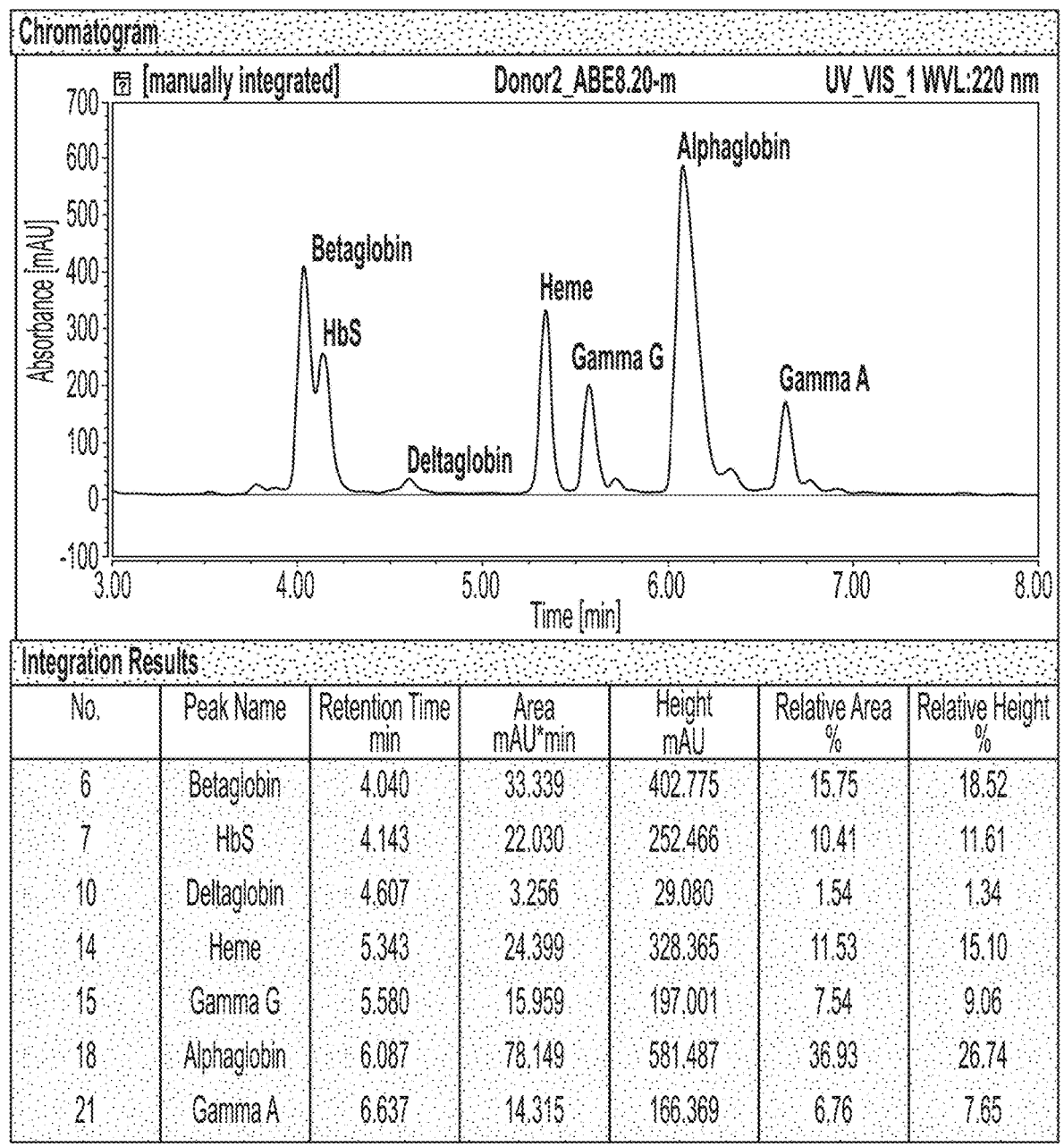
Figure 30B:
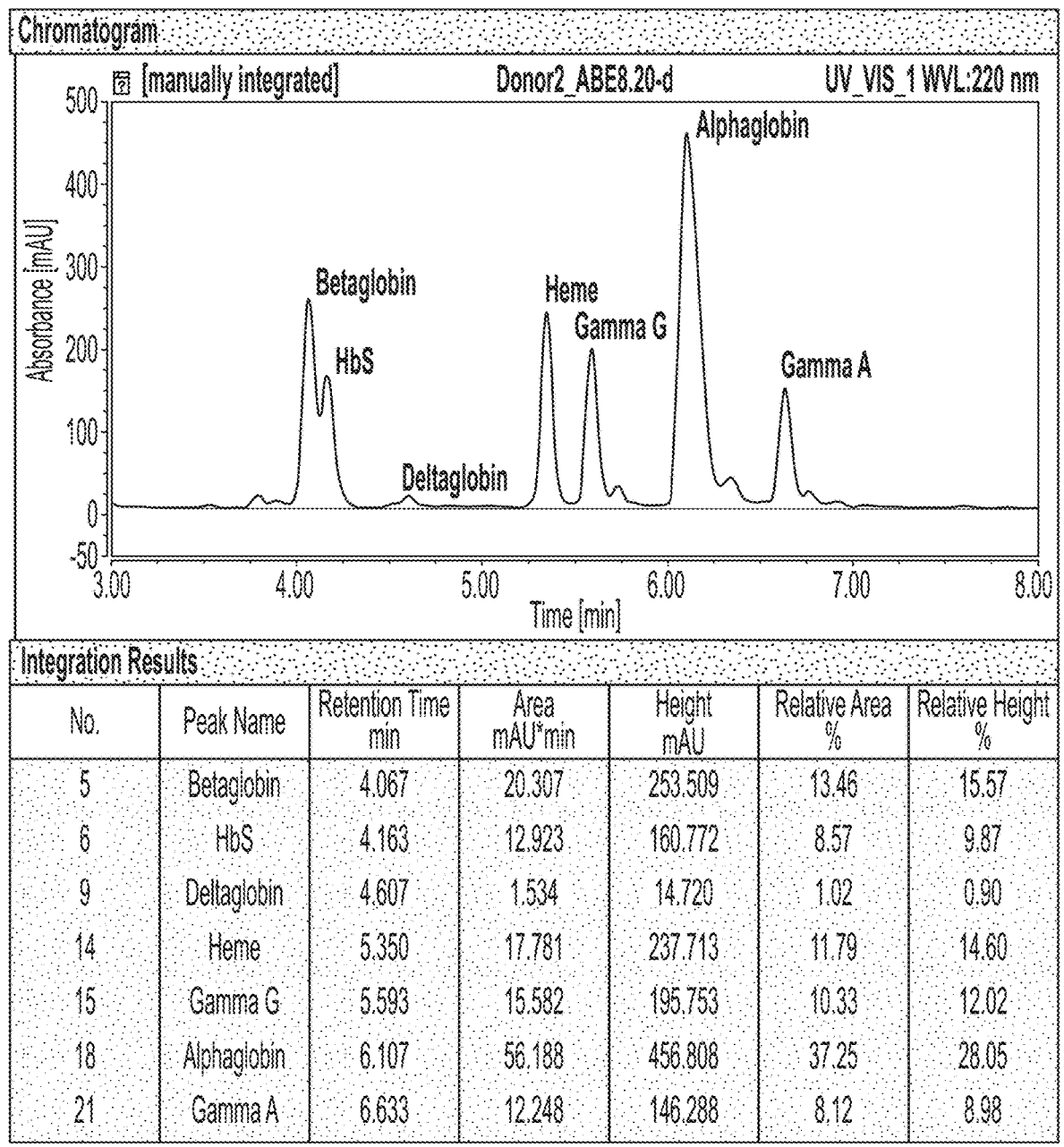

FIGS. 30A and 30B depict UHPLC UV-Vis traces (220 nm) and integration of globin chain levels of differentiated CD34+ cells treated with ABE8s. FIG. 30A depicts an UHPLC UV-Vis trace (220 nm) and integration of globin chain levels of differentiated CD34+ cells treated with ABE8.20-m (donor 2). Note: donor 2 is heterozygous for sickle cell disease. FIG. 30B depicts an UHPLC UV-Vis trace (220 nm) and integration of globin chain levels of differentiated CD34+ cells treated with ABE8.20-d (donor 2). Note: donor 2 is heterozygous for sickle cell disease.

Figure 31A:
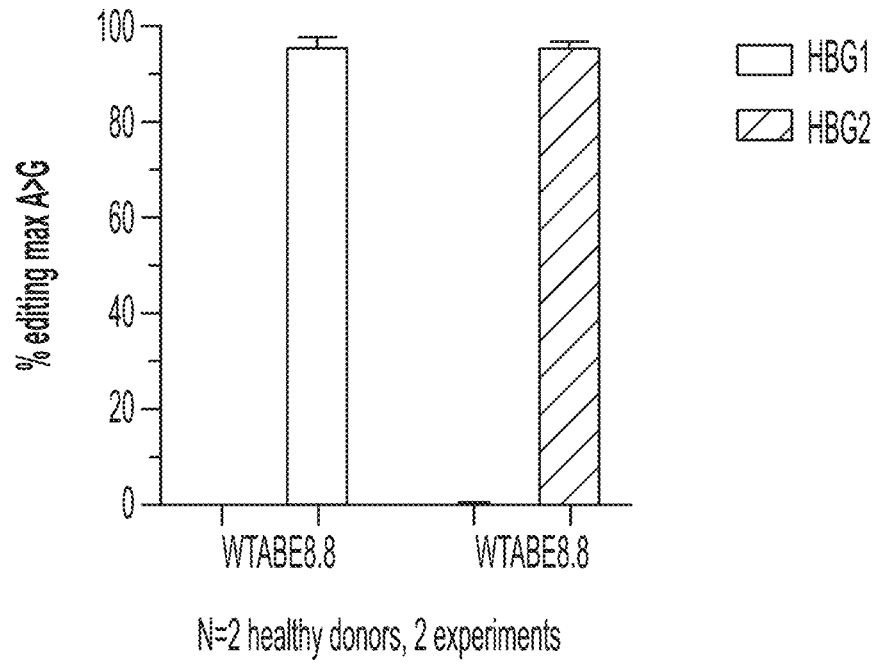
Figure 31B:
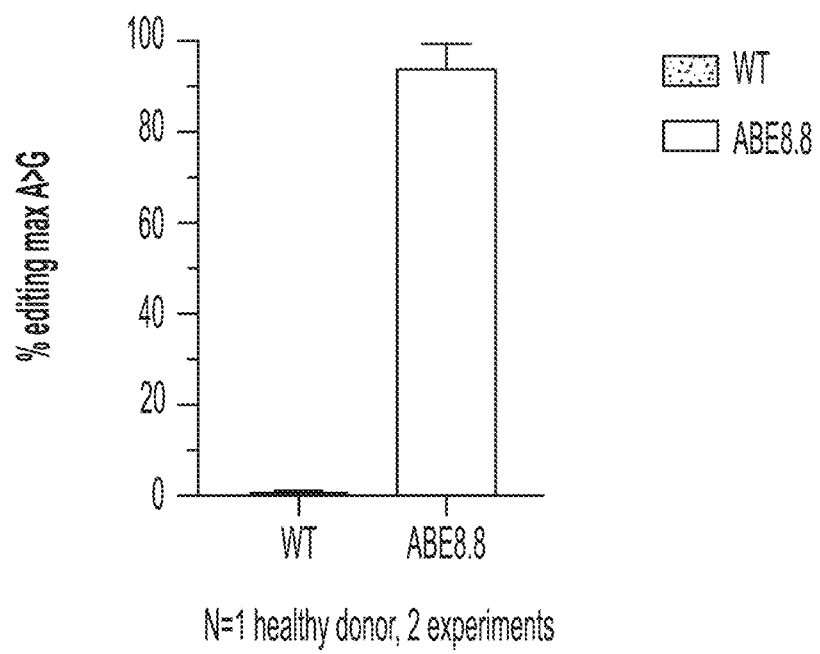
Figure 31C:
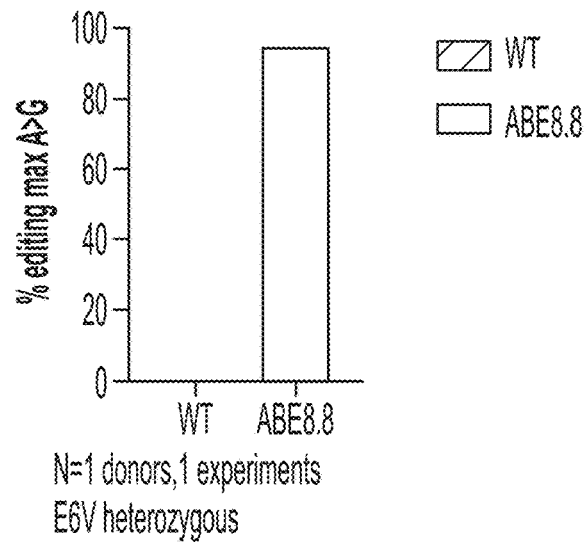
Figure 31D:
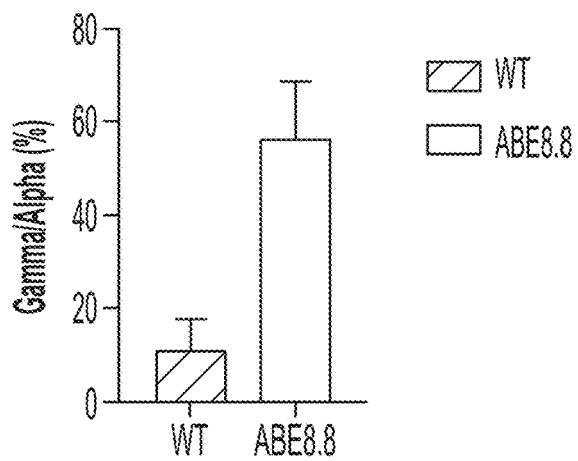
Figure 31E:
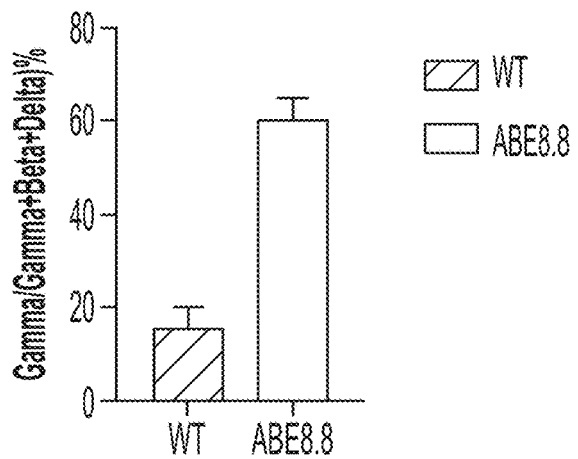

FIG. 31A-31E depict editing with ABE8.8 at two independent sites reached over 90% editing on day 11 post erythroid differentiation before enucleation and about 60% of gamma globin over alpha globin or total beta family globin on day 18 post erythroid differentiation. FIG. 31A is a graph depicting an average of ABE8.8 editing in 2 healthy donors in 2 independent experiments. Editing efficiency was measured with primers that distinguish HBG1 and HBG2. FIG. 31B is a graph depicting an average of 1 healthy donor in 2 independent experiments. Editing efficiency was measured with primers that recognize both HBG1 and HBG2. FIG. 31C is a graph depicting editing of ABE8.8 in a donor with heterozygous E6V mutation. FIGS. 31D and 31E are graphs depicting gamma globin increase in the ABE8.8 edited cells.

Figure 32A:
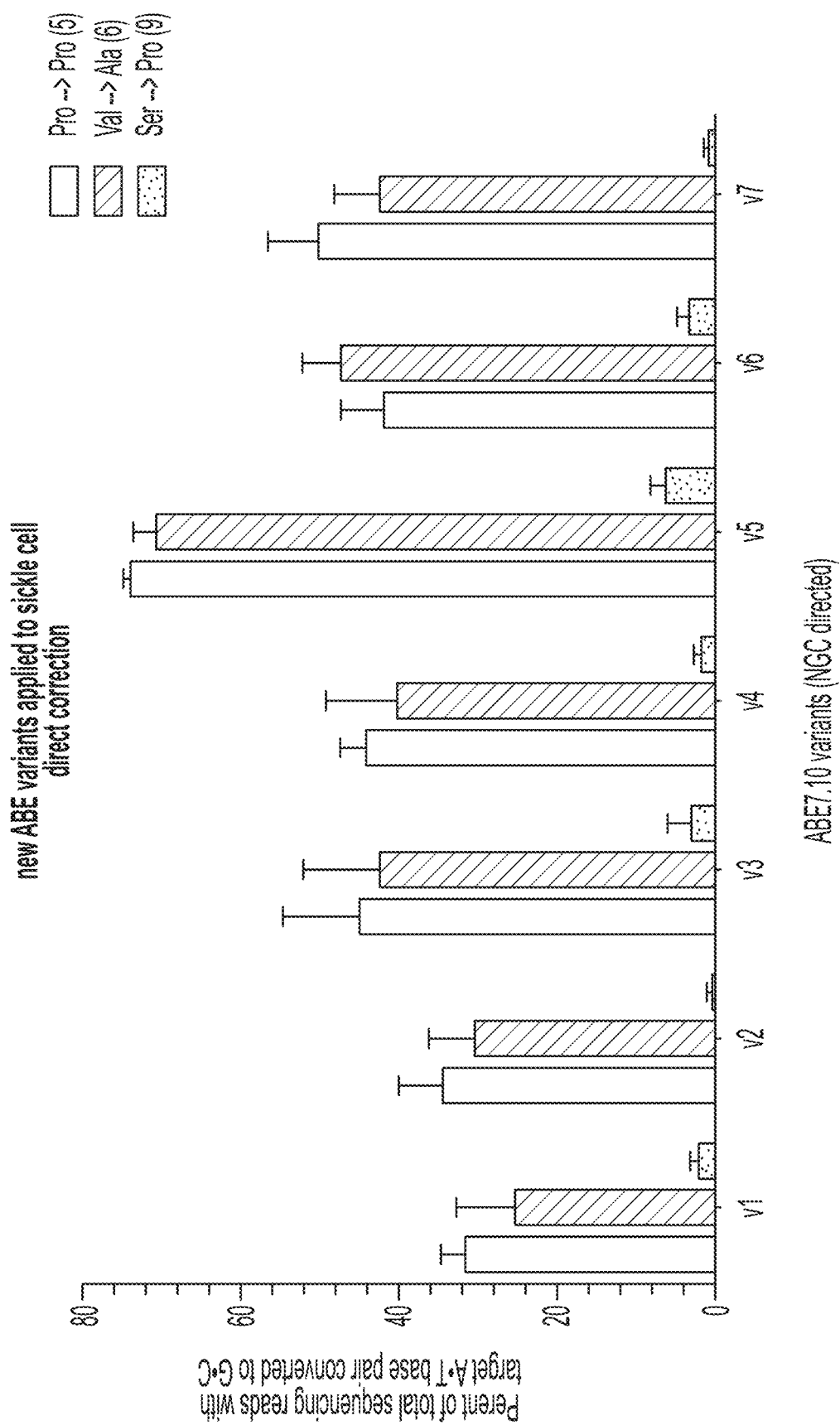
Figure 32B:
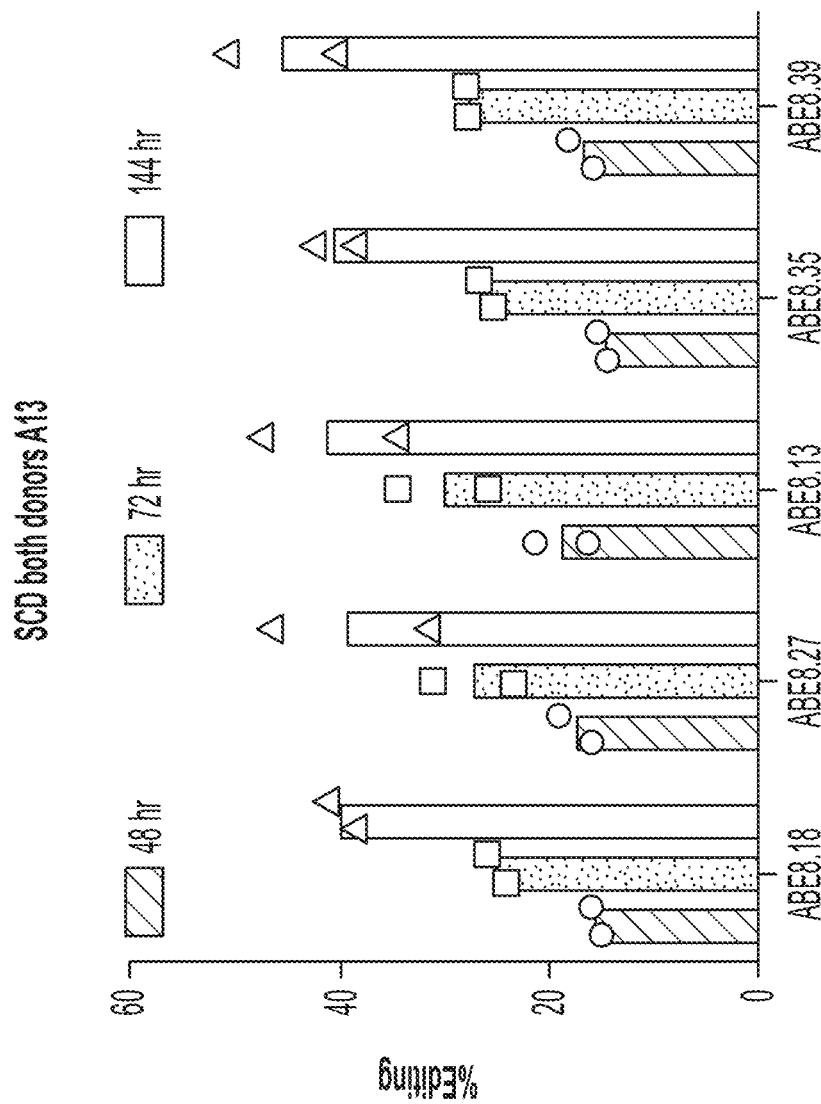

FIGS. 32A and 32B depict percent editing using ABE variants to correct sickle cell mutations. FIG. 32A is a graph depicting a screen of different editor variants with about 70% editing in SCD patient fibroblasts. FIG. 32B is a graph depicting CD34 cells from healthy donors edited with a lead ABE variant, targeting a synonymous mutation A13 in an adjacent proline that resides within the editing window and serves as a proxy for editing the SCD mutation. ABE8 variants showed an average editing frequency around 40% at the proxy A13.

Figure 33A:
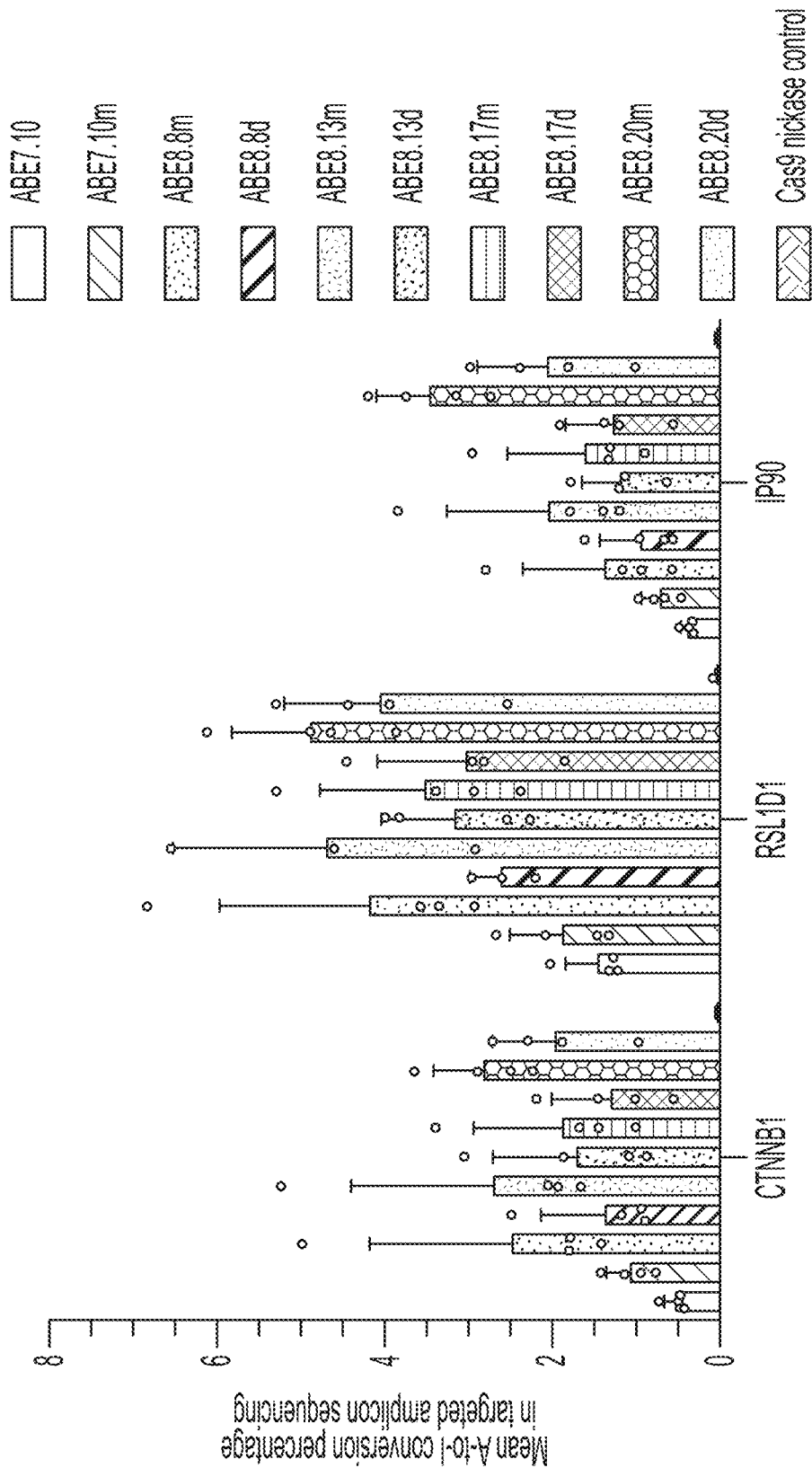
Figure 33B:
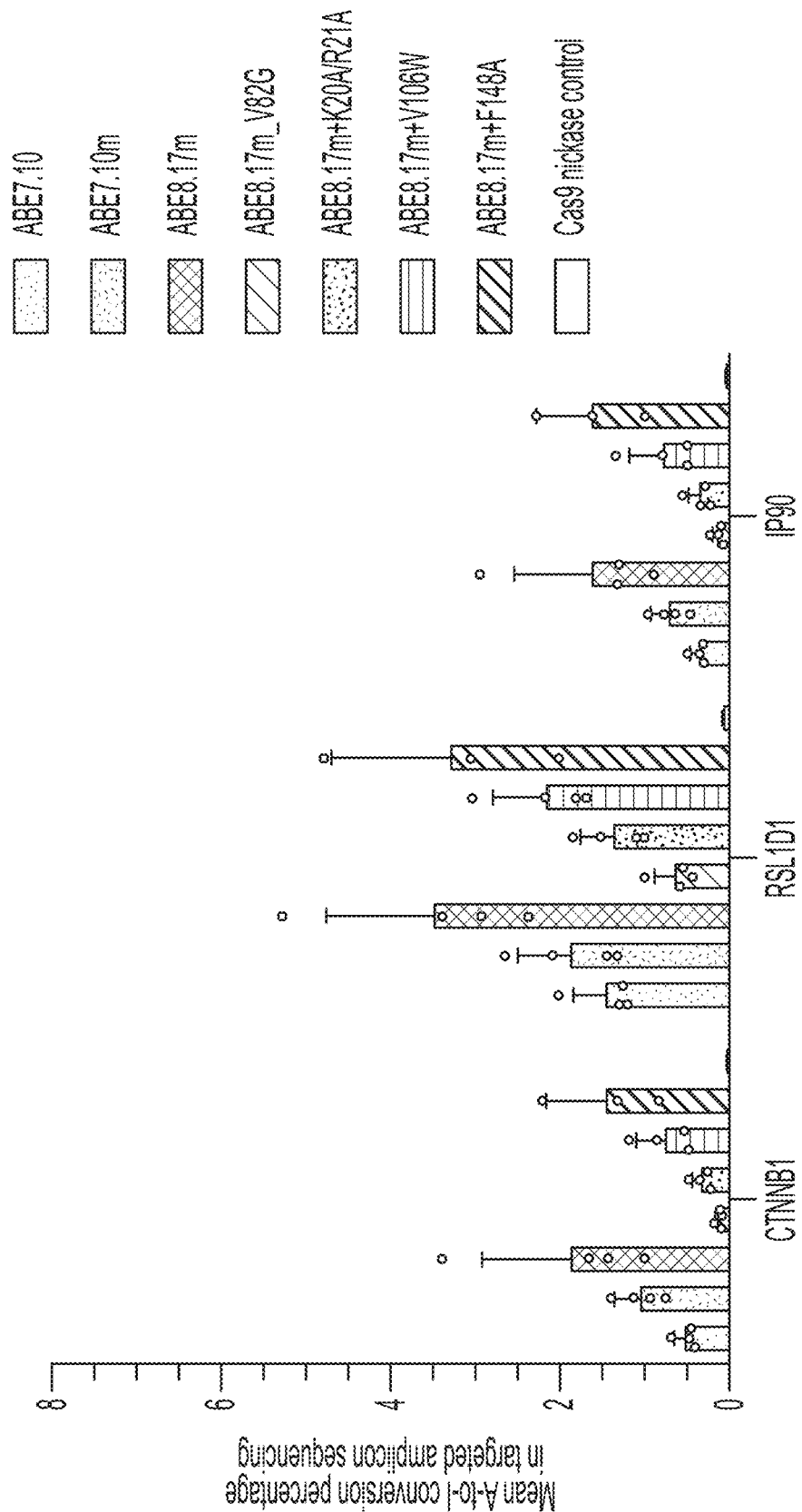

FIGS. 33A and 33B depict RNA amplicon sequencing to detect cellular A-to-I editing in RNA associated with ABE treatment. Individual data points are shown and error bars represent s.d. for n=3 independent biological replicates, performed on different days. FIG. 33A is a graph depicting A-to-I editing frequencies in targeted RNA amplicons for core ABE 8 constructs as compared to ABET and Cas9 (D10A) nickase control. FIG. 33B is a graph depicting A-to-I editing frequencies in targeted RNA amplicons for ABE8 with mutations that have been reported to improve RNA off-target editing.

Figure 34A:
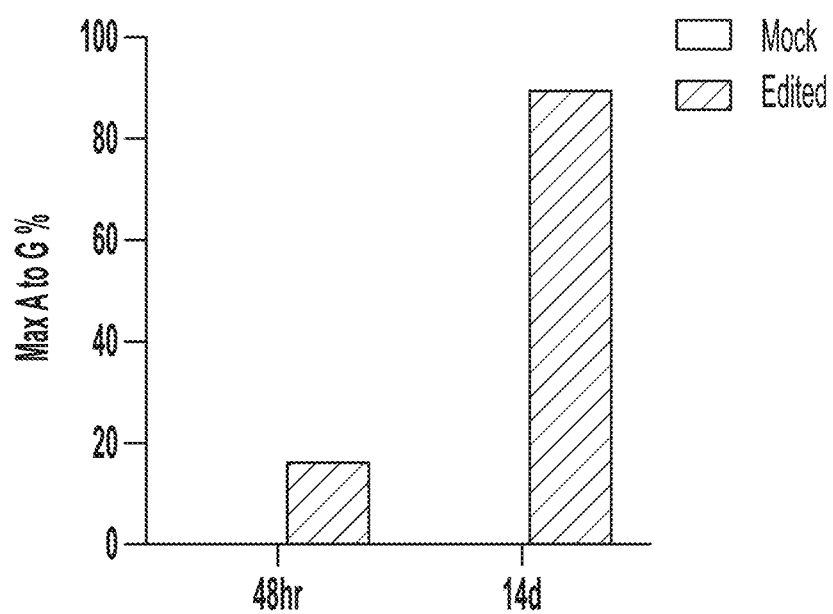
Figure 34B:
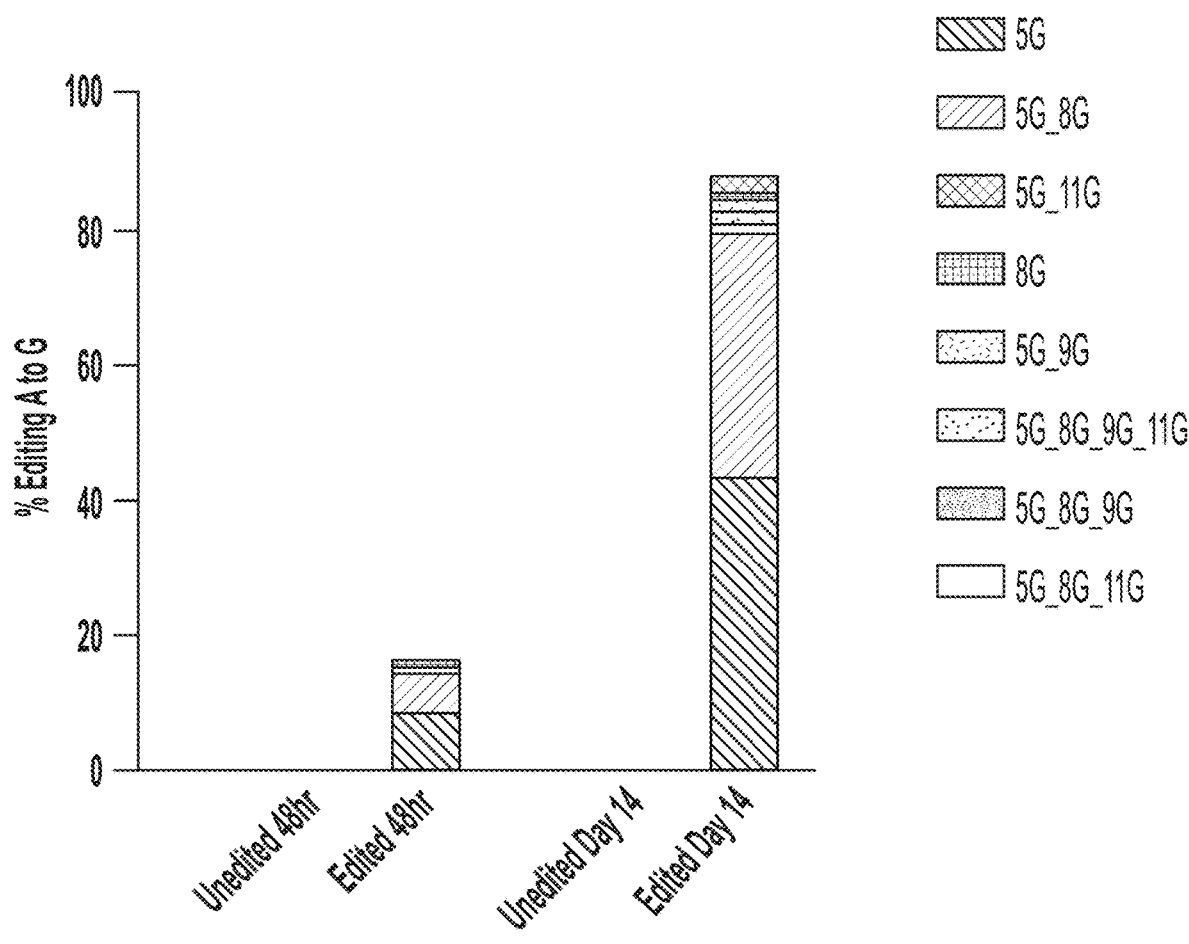

FIGS. 34A and 34B present graphs and UPHLC chromatographic traces related to editing of SCD CD34+ cells. CD34+ cells from a patient having SCD were transfected with ABE8.8 mRNA and sgRNA (HBG1/2, 50 nM) using electroporation. Edited cells were differentiated to erythroid cells in vitro. The editing rate at HBG1/2 promoters was measured by Next-Genome Sequencing (NGS). As shown in FIG. 34A, 16.5% editing by the ABE8.8 base editor was observed at 48 hours post differentiation, and 89.2% editing was measured on day 14 post differentiation. FIG. 34B shows the breakdown of bystander editing at 48 hours and on day 14 post-differentiation.

Figure 35A:
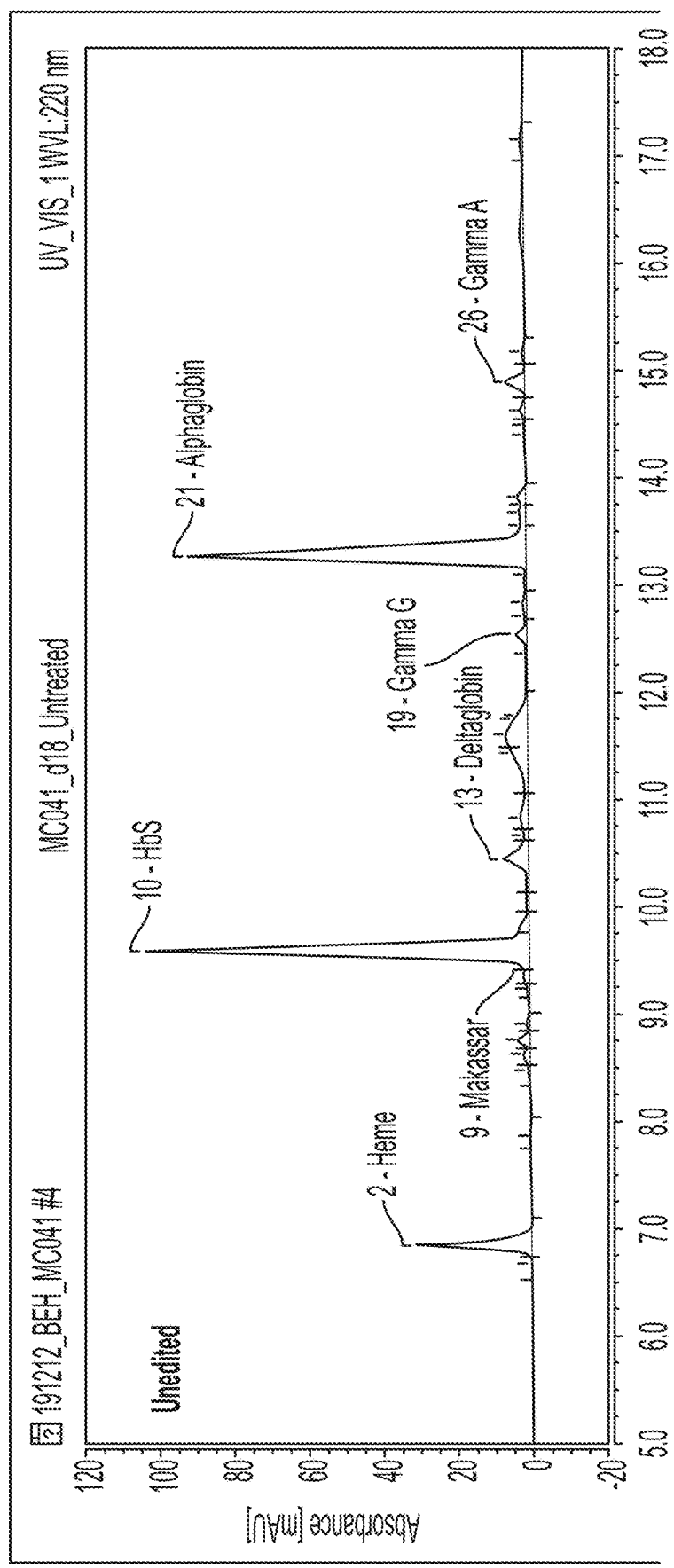
Figure 35B:
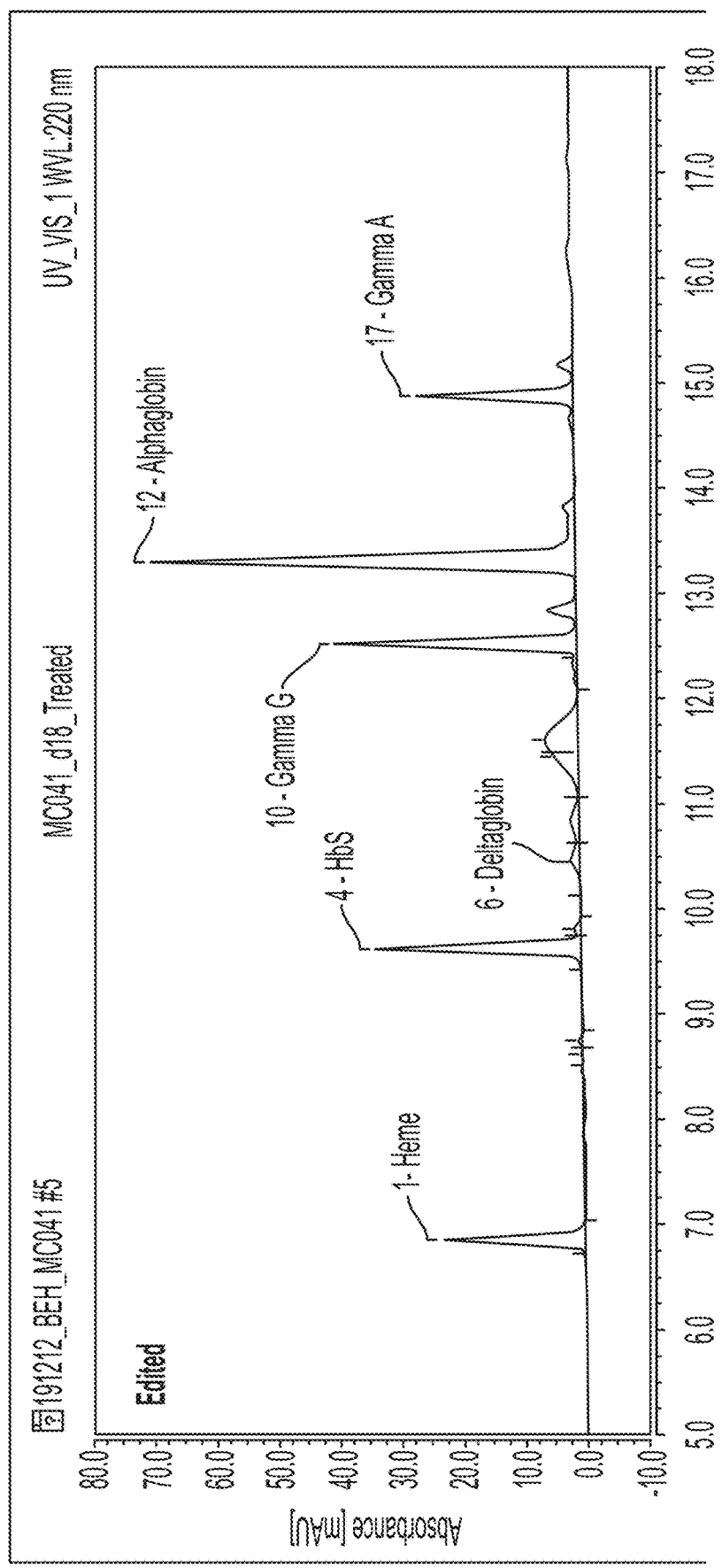
Figure 35C:
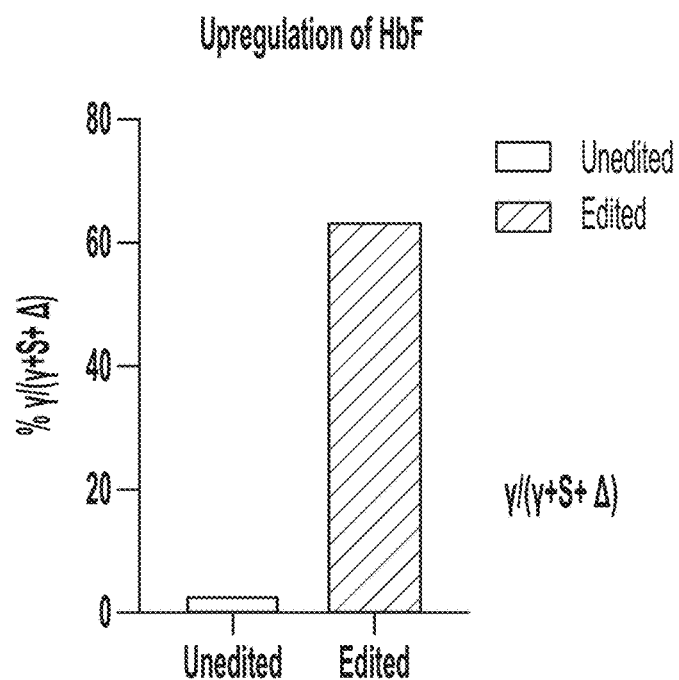
Figure 35D:
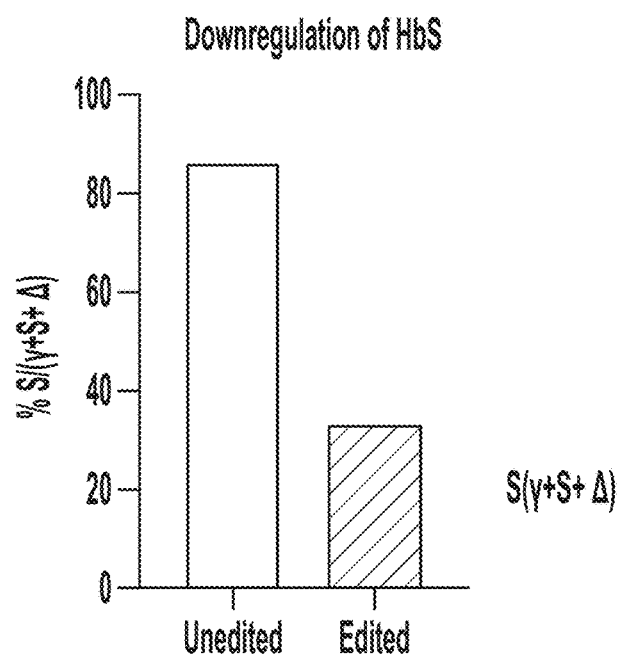

FIGS. 35A-35D present UPHLC chromatographic traces of globin levels and graphs related to functional readout of HbF upregulation and HbS downregulation in SCD CD34+ cells subjected to editing as described for FIGS. 34A and 34B. Edited SCD CD34+ cells were differentiated to erythroid cells and globin levels were analyzed on day 18 post differentiation. FIG. 35A presents a trace showing globin levels in erythroid cells differentiated from unedited SCD CD34+ cells. FIG. 35B presents a trace showing globin levels in erythroid cells differentiated from edited SCD CD34+ cells. FIG. 35C shows that 63.2% of γ globin level was detected in erythroid cells differentiated from edited SCD CD34+ cells versus unedited cells. FIG. 35D shows that S globin was reduced from 86% to 32.9% differentiated from edited SCD CD34+ cells versus unedited cells. The upregulation of fetal hemoglobin is an approach that is advantageous for the treatment of SCD as well as beta-thalassemia.

Figure 36A:
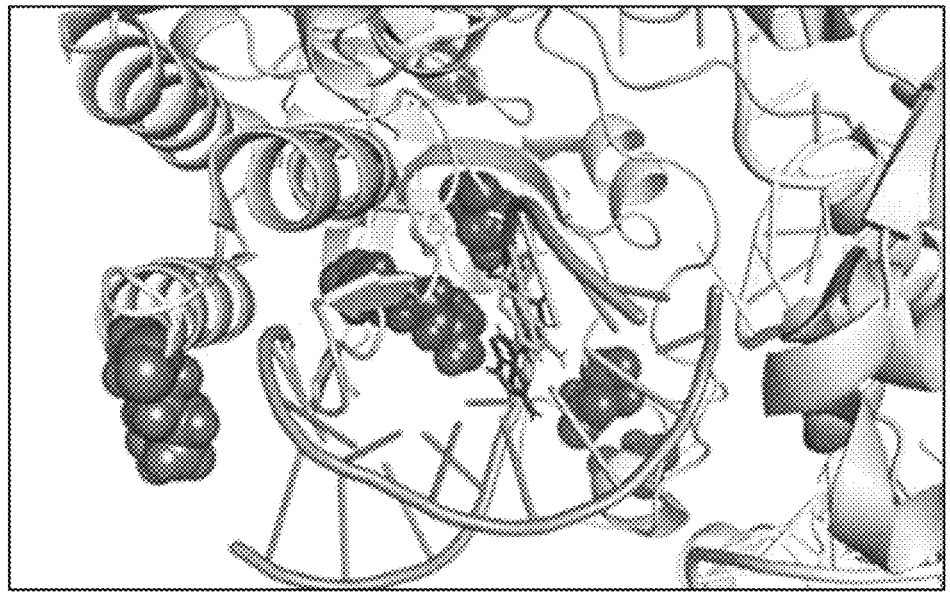
Figure 36B:
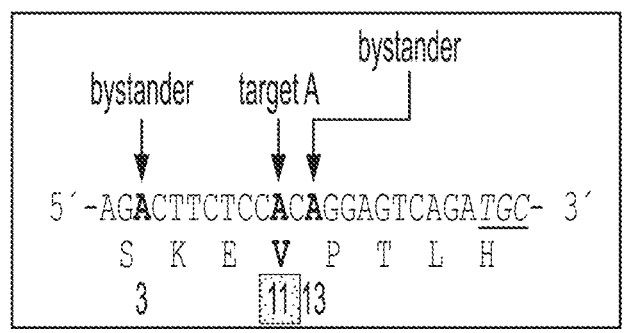
Figure 36C:
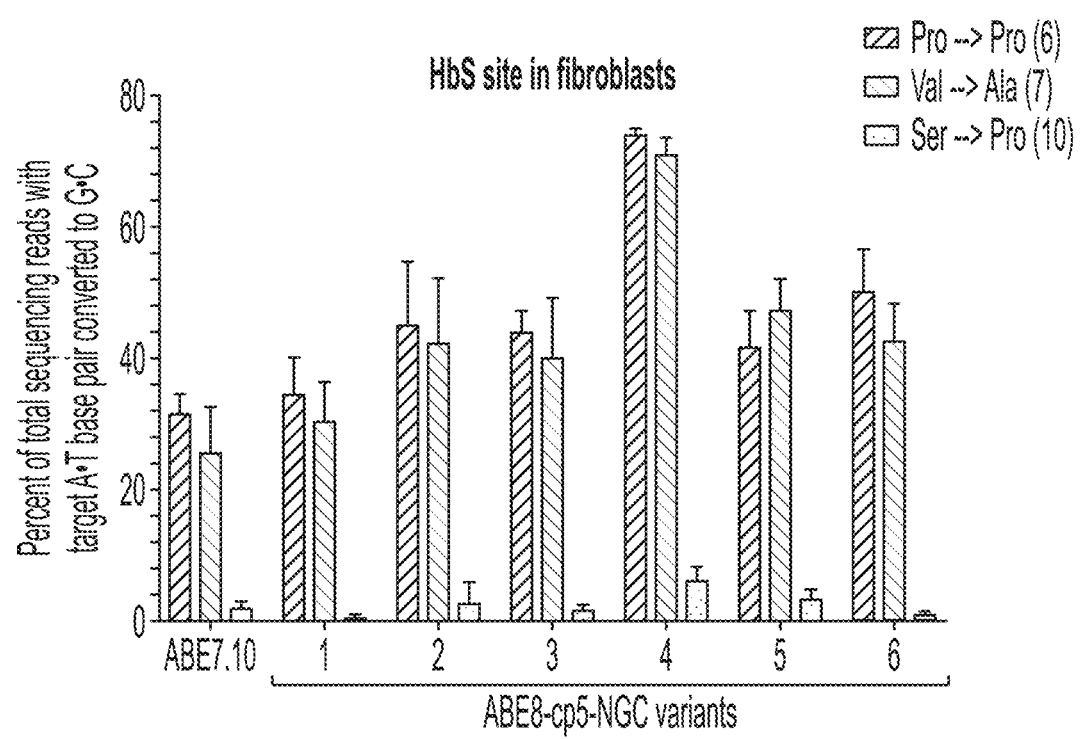

FIGS. 36A-36C show a ribbon structure, target sequence, and graph related to the generation of a variant of the ABE editor for editing a non-canonical Cas9 NGG PAM sequence. Designing an ABE base editor containing a modified SpCas9 including MQKFRAER amino acid substitutions and having specificity for the altered PAM 5'-NGC-3' as described herein (FIG. 36A), allowed for targeting the sickle allele ("target A") within the editing window of ABE as shown in FIG. 36B, thereby providing ability to directly edit this position in the target site, which would not normally be accessible using a traditional spCas9. FIG. 36B discloses SEQ ID NOS 299-300, respectively, in order of appearance. FIG. 36C shows a graph of the base editing activities of variant editors containing the MQKFRAER amino acid substitutions, which allow recognition of the target site and the conversion of nucleobase A to nucleobase T (A•T) to achieve the desired correction of the Val→Ala. For each variant plotted on the x-axis, "Pro→Pro" represents the leftmost bar; "Val→Ala" represents the middle bar; and "Ser→Pro" represents the rightmost bar.

Figure 37:
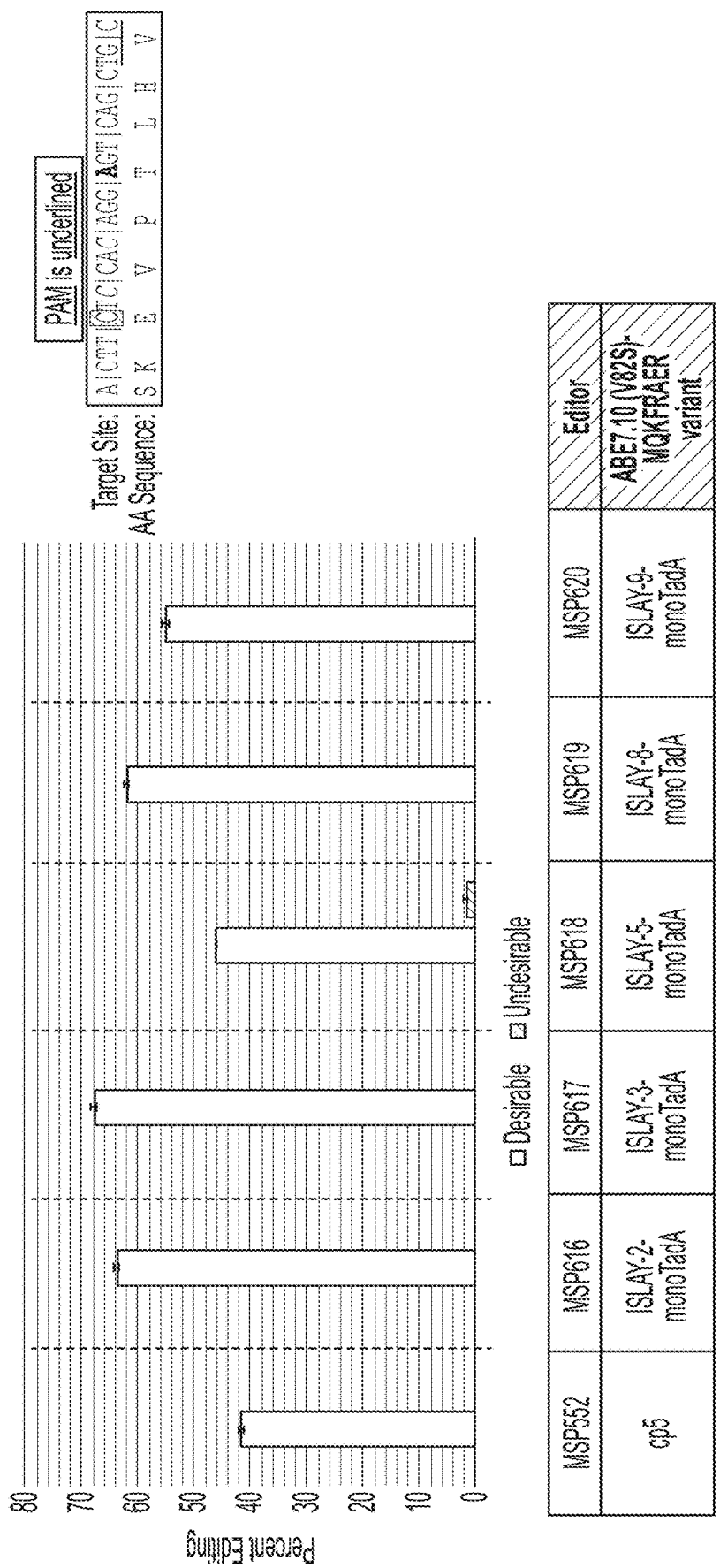

FIG. 37 presents a graph, target site sequence and table related to the generation of additional adenosine deaminase variants in which the linker to the TadA was removed and placed in closer proximity to the Cas9 complex. These variants exhibited increased efficacy in editing of a model cell line (HEK293T) that expressed the sickle allele target site. The term "ISLAY" or "IBE" refers to base editors that have an insertion of the TadA adenosine deaminase within the Cas9 sequence, for example, ISLAY1 V1015, ISLAY2 I1022, ISLAY3 I1029, ISLAY4 E1040, ISLAY5 E1058, ISLAY6 G1347, ISLAY7 E1054, ISLAY8 E1026 and ISLAY9 Q768, as set forth in Table 14A infra. At the right side of the figure, the target site in the nucleic acid sequence (SEQ ID NO: 301), the PAM site and the corresponding amino acid sequence (SEQ ID NO: 302) are shown. "Cp5" (MSP552) in the table refers to an ABE8 in a scaffold that includes a circular permutant Cas9 having the amino acid sequence below and as described infra.

(SEQ ID NO: 77)
MSEVEFSHEYWMRHALTLAKRAWDEREVPVGAVLVHNNRVIGEGWNRPIG
RHDPTAHAEIMALRQGGLVMQNYRLIDATLYVTLEPCVMCAGAMIHSRIG
RVVFGARDAKTGAAGSLMDVLHHPGMNHRVEITEGILADECAALLSDFFR
MRRQEIKAQKKAQSSTDSGGSSGGSSGSETPGTSESATPESSGGSSGGSS
EVEFSHEYWMRHALTLAKRARDEREVPVGAVLVLNNRVIGEGWNRAIGLH
DPTAHAEIMALRQGGLVMQNYRLIDATLYSTFEPCVMCAGAMIHSRIGRV
VFGVRNAKTGAAGSLMDVLHYPGMNHRVEITEGILADECAALLCYFFRMP
RQVFNAQKKAQSSTDSGGSSGGSSGSETPGTSESATPESSGGSSGGSEIG
KATAKYFFYSNIMNFFKTEITLANGEIRKRPLIETNGETGEIVWDKGRDF
ATVRKVLSMPQVNIVKKTEVQTGGFSKESILPKRNSDKLIARKKDWDPKK
YGGFMQPTVAYSVLVVAKVEKGKSKKLKSVKELLGITIMERSSFEKNPID
FLEAKGYKEVKKDLIIKLPKYSLFELENGRKRMLASAKFLQKGNELALPS
KYVNFLYLASHYEKLKGSPEDNEQKQLFVEQHKHYLDEIIEQISEFSKRV
ILADANLDKVLSAYNKHRDKPIREQAENIIHLFTLTNLGAPRAFKYFDTT
IARKEYRSTKEVLDATLIHQSITGLYETRIDLSQLGGDGSGGSGGSGGS
GGSGGSGGMDKKYSIGLAIGTNSVGWAVITDEYKVPSKKFKVLGNTDRHS
IKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKL
VDSTDKADLRLIYLALAHMIKFRGHFLIEGDLNPDNSDVDKLFIQLVQTY
NQLFEENPINASGVDAKAILSARLSKSRRLENLIAQLPGEKKNGLFGNLI
ALSLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQQ
LPEKYKEIFFDQSKNGYAGYIDGGASQEEFYKFIKPILEKMDGTEELLVK
LNREDLLRKQRTFDNGSIPHQIHLGELHAILRRQEDFYPFLKDNREKIEK
ILTFRIPYYVGPLARGNSRFAWMTRKSEETITPWNFEEVVDKGASAQSFI
ERMTNFDKNLPNEKVLPKHSLLYEYFTVYNELTKVKYVTEGMRKPAFLSG
EQKKAIVDLLFKTNRKVTVKQLKEDYFKKIECFDSVEISGVEDRFNASLG
TYHDLLKIIKDKDFLDNEENEDILEDIVLTLTLFEDREMIEERLKTYAHL
FDDKVMKQLKRRRYTGWGRLSRKLINGIRDKQSGKTILDFLKSDGFANRN
FMQLIHDDSLTFKEDIQKAQVSGQGDSLHEHIANLAGSPAIKKGILQTVK
VVDELVKVMGRHKPENIVIEMARENQTTQKGQKNSRERMKRIEEGIKELG
SQILKEHPVENTQLQNEKLYLYYLQNGRDMYVDQELDINRLSDYDVDHIV
PQSFLKDDSIDNKVLTRSDKNRGKSDNVPSEEVVKKMKNYWRQLLNAKLI
TQRKFDNLTKAERGGLSELDKAGFIKRQLVETRQITKHVAQILDSRMNTK
YDENDKLIREVKVITLKSKLVSDFRKDFQFYKVREINNYHHAHDAYLNAV
VGTALIKKYPKLESEFVYGDYKVYDVRKMIAKSEQEGADKRTADGSEFES
PKKKRKV

For the experiments, 20nt guide sgRNA (1000 ng), spCas9-MQKFRAER, having specificity for NGC PAM, were used to transform HEK293T cells (2×10$^5$ cells/well) in triplicate.

Figure 38:
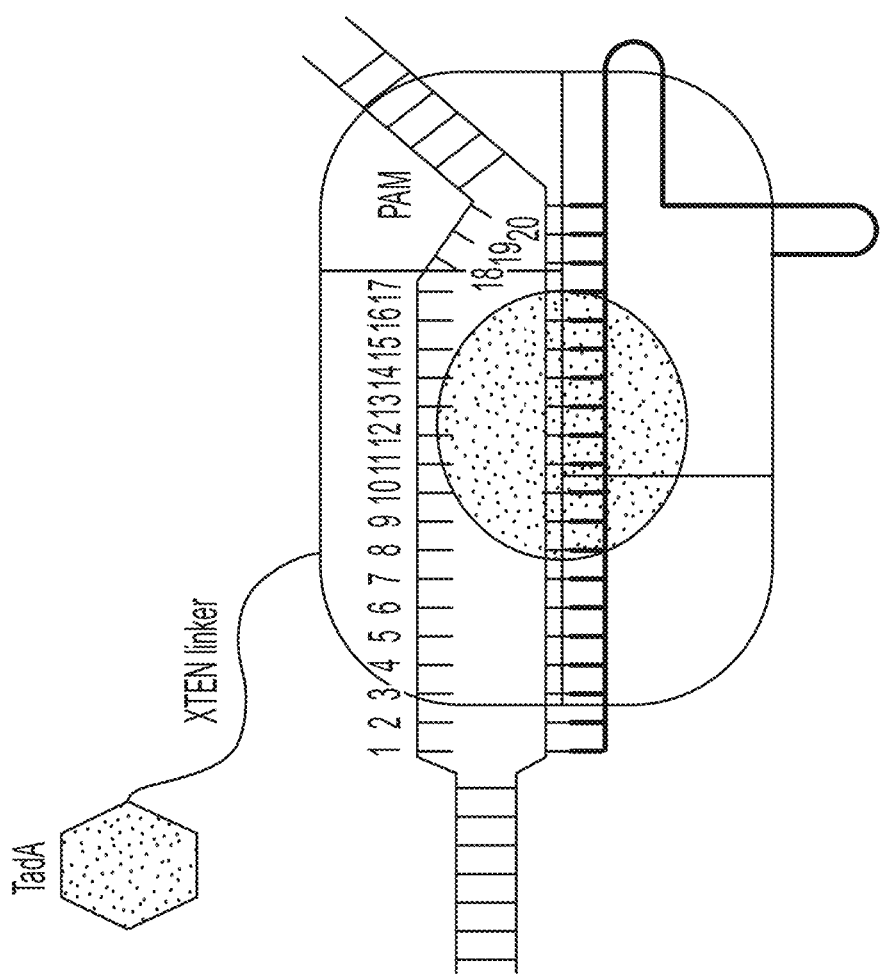
Figure 38:
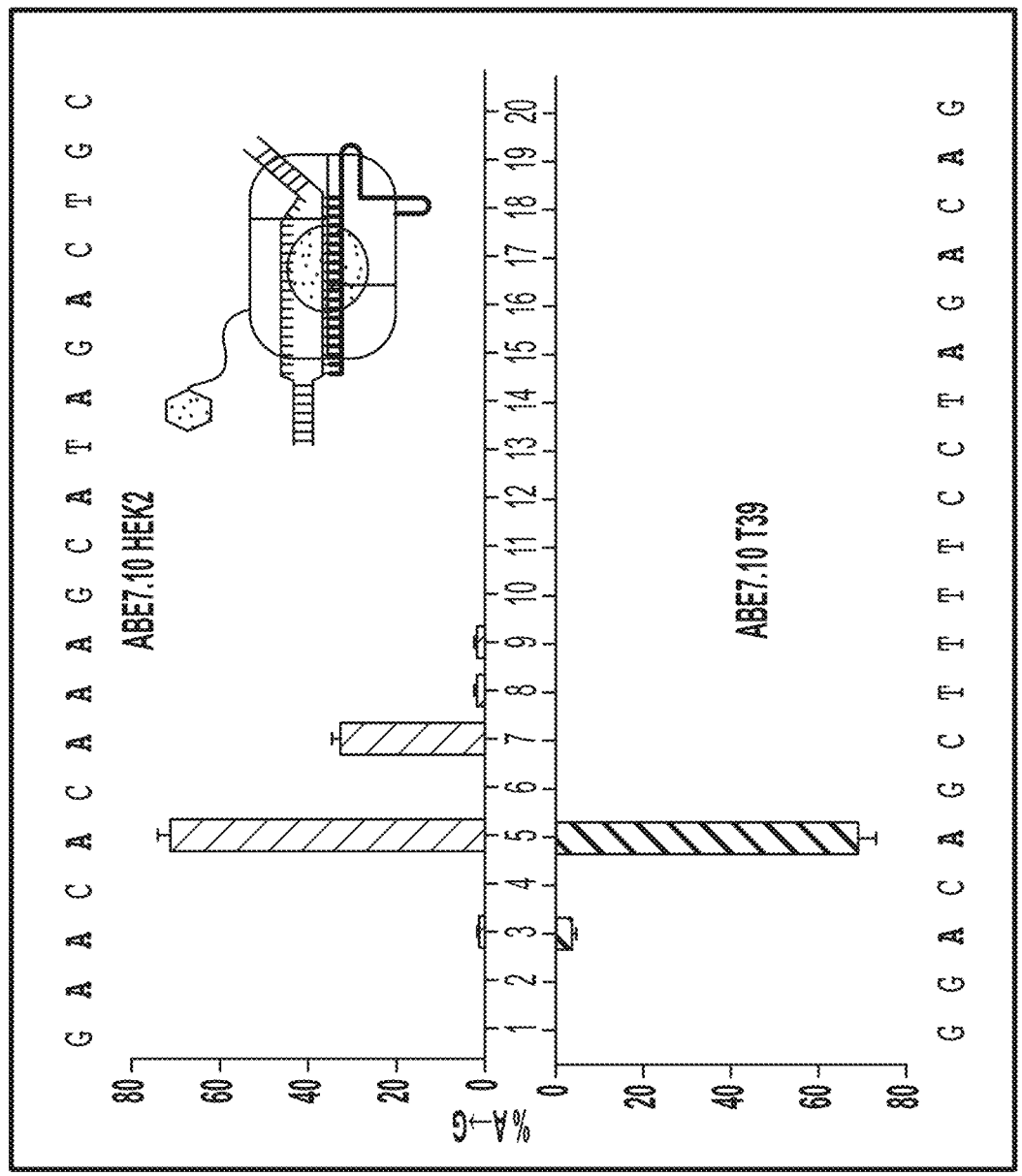
Figure 38:
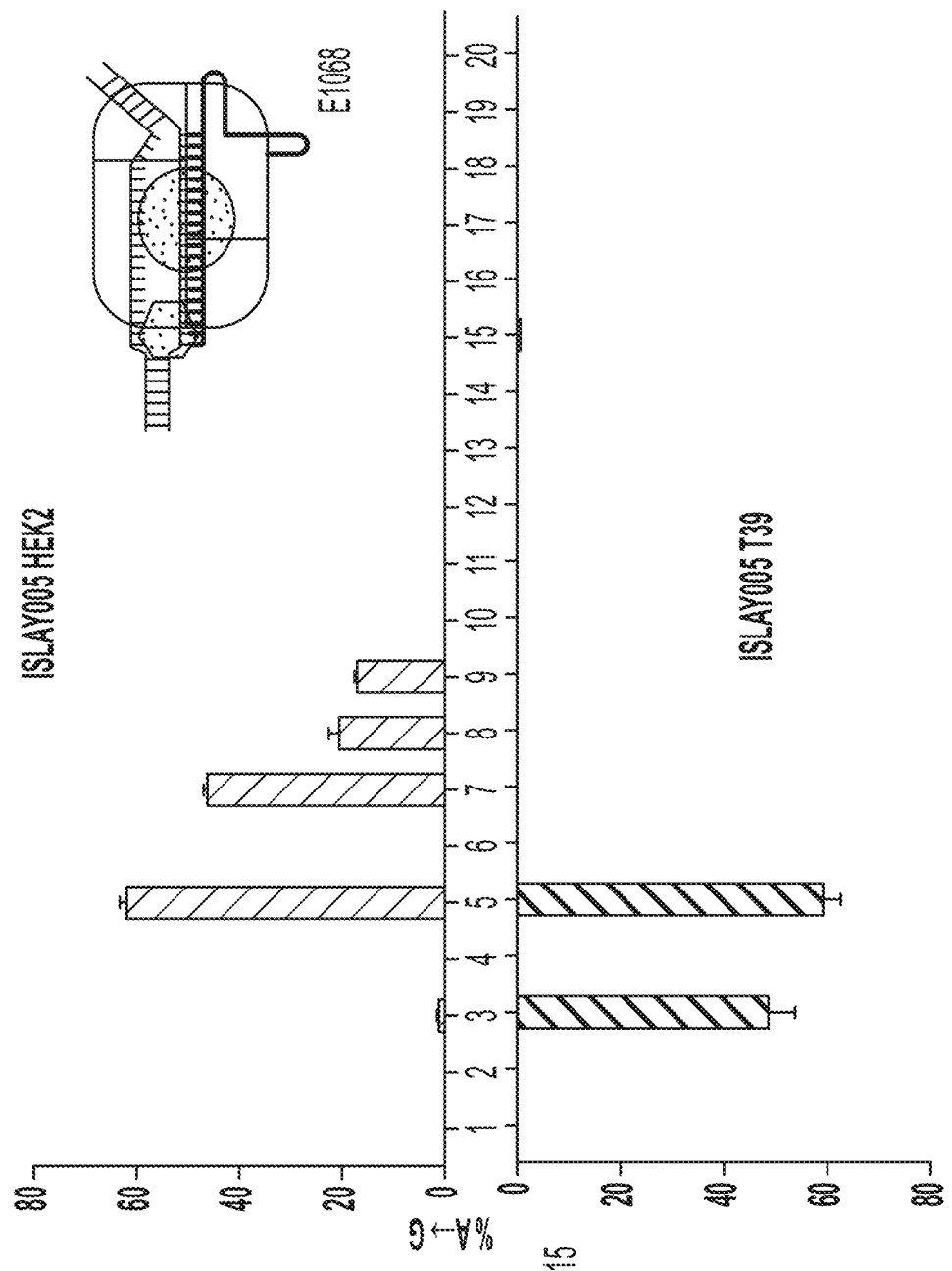
Figure 38:
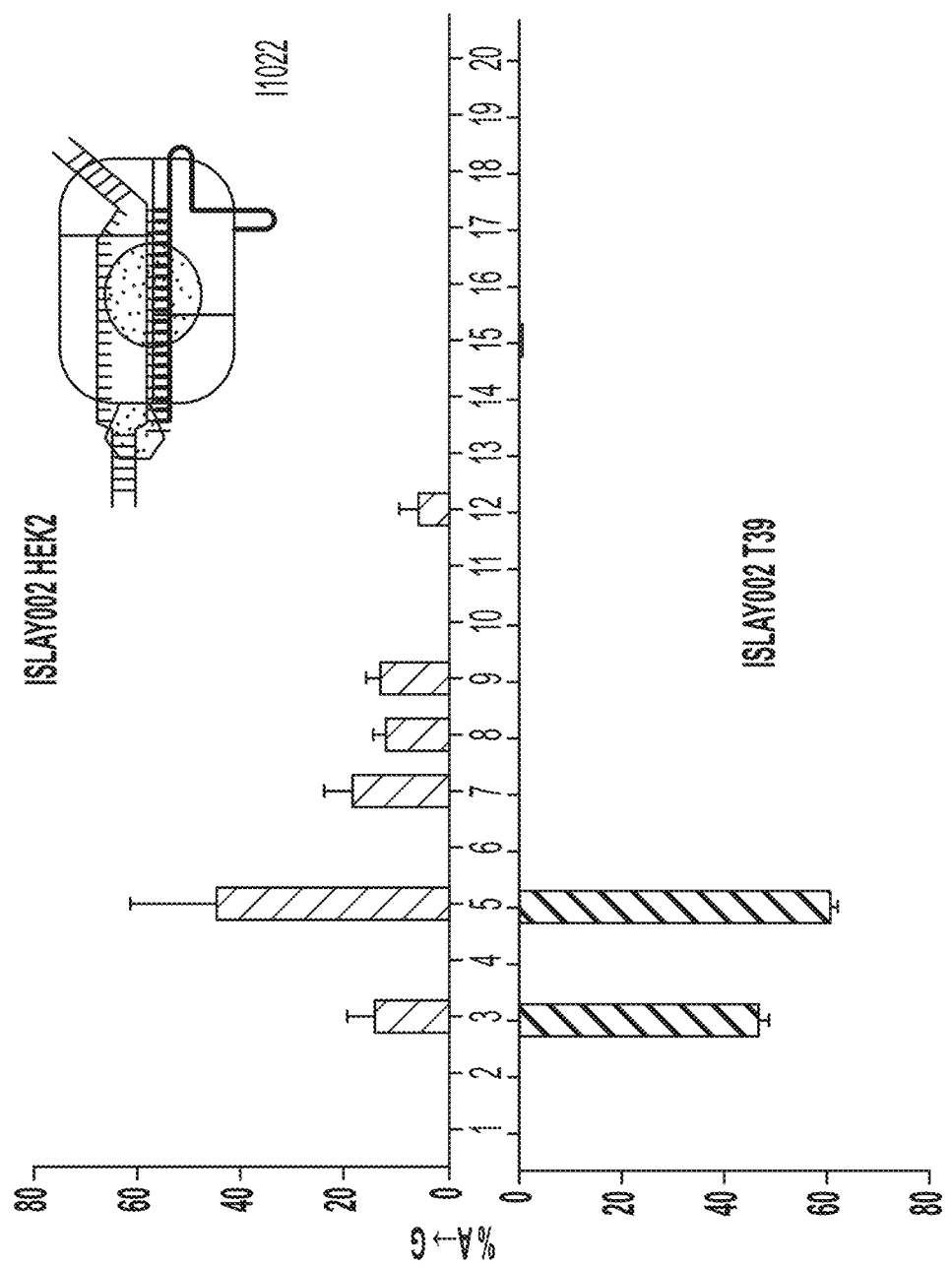
Figure 38:
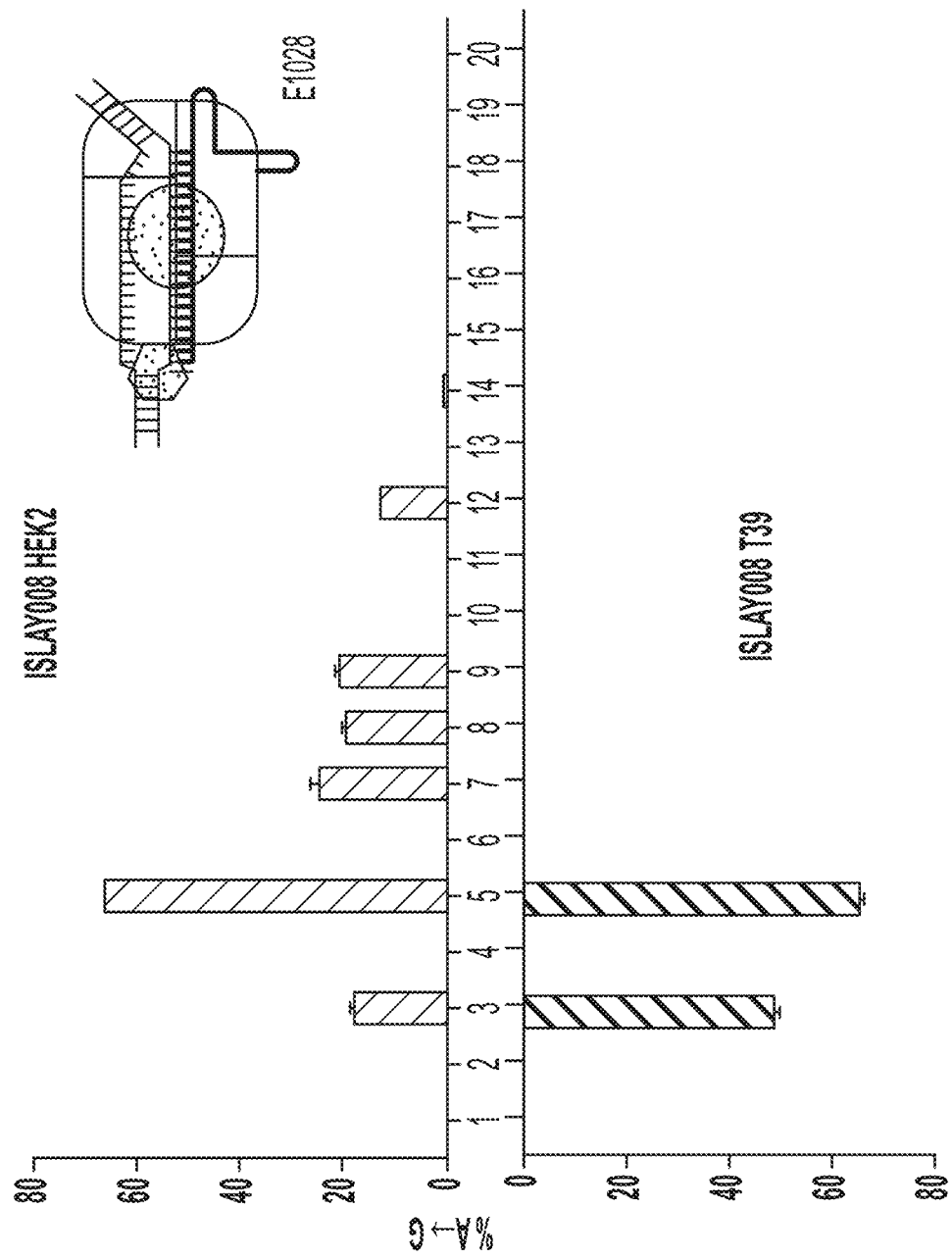
Figure 38:
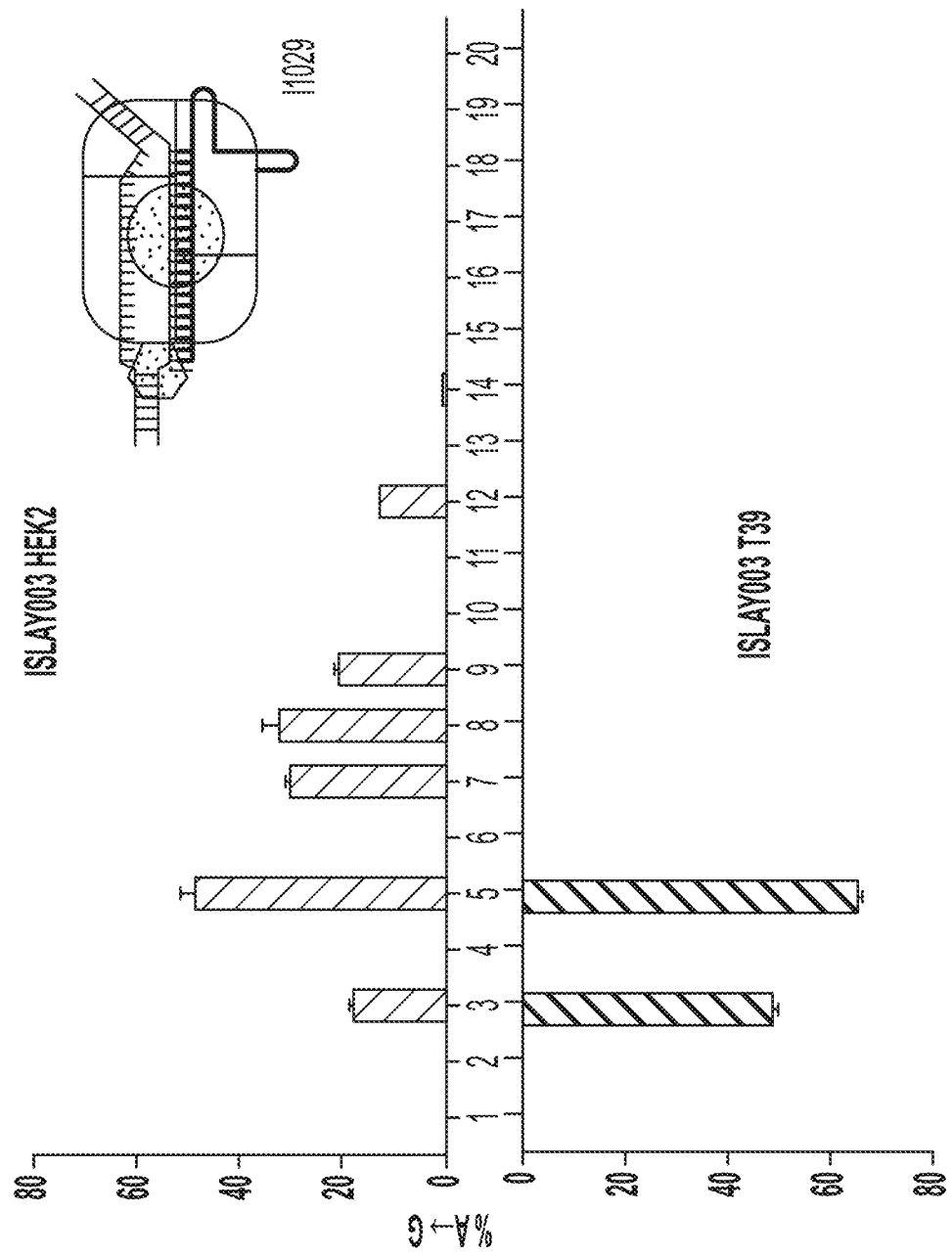
Figure 39:
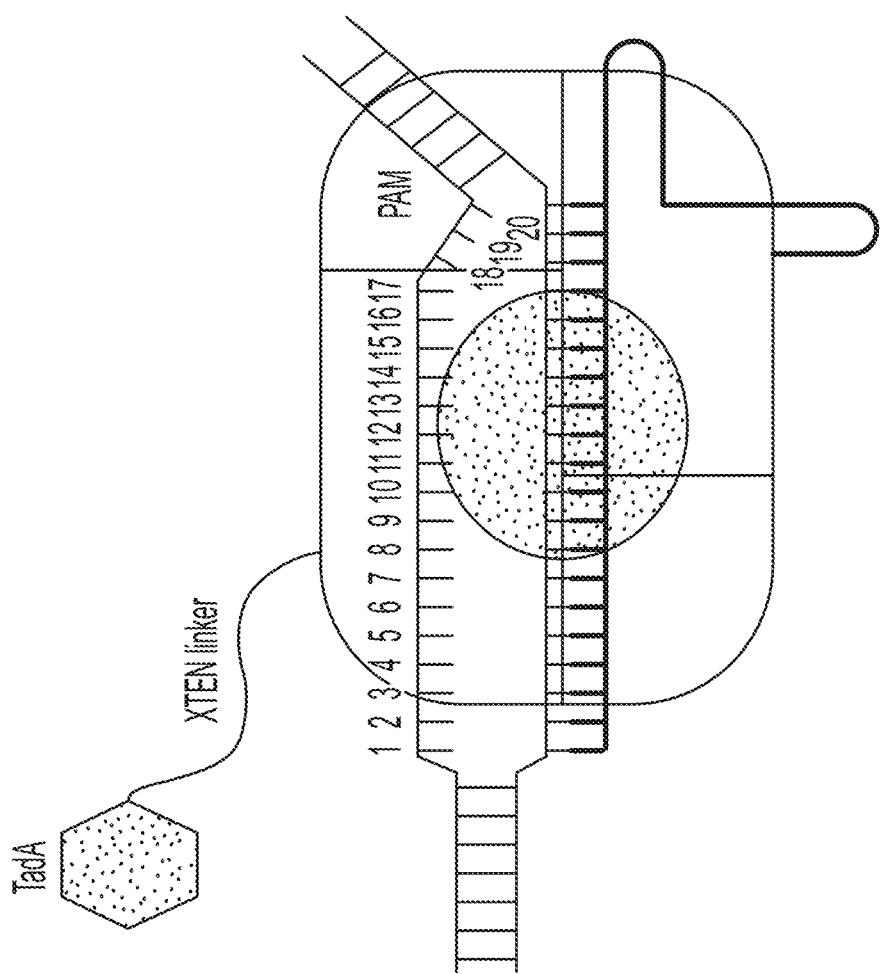
Figure 39:
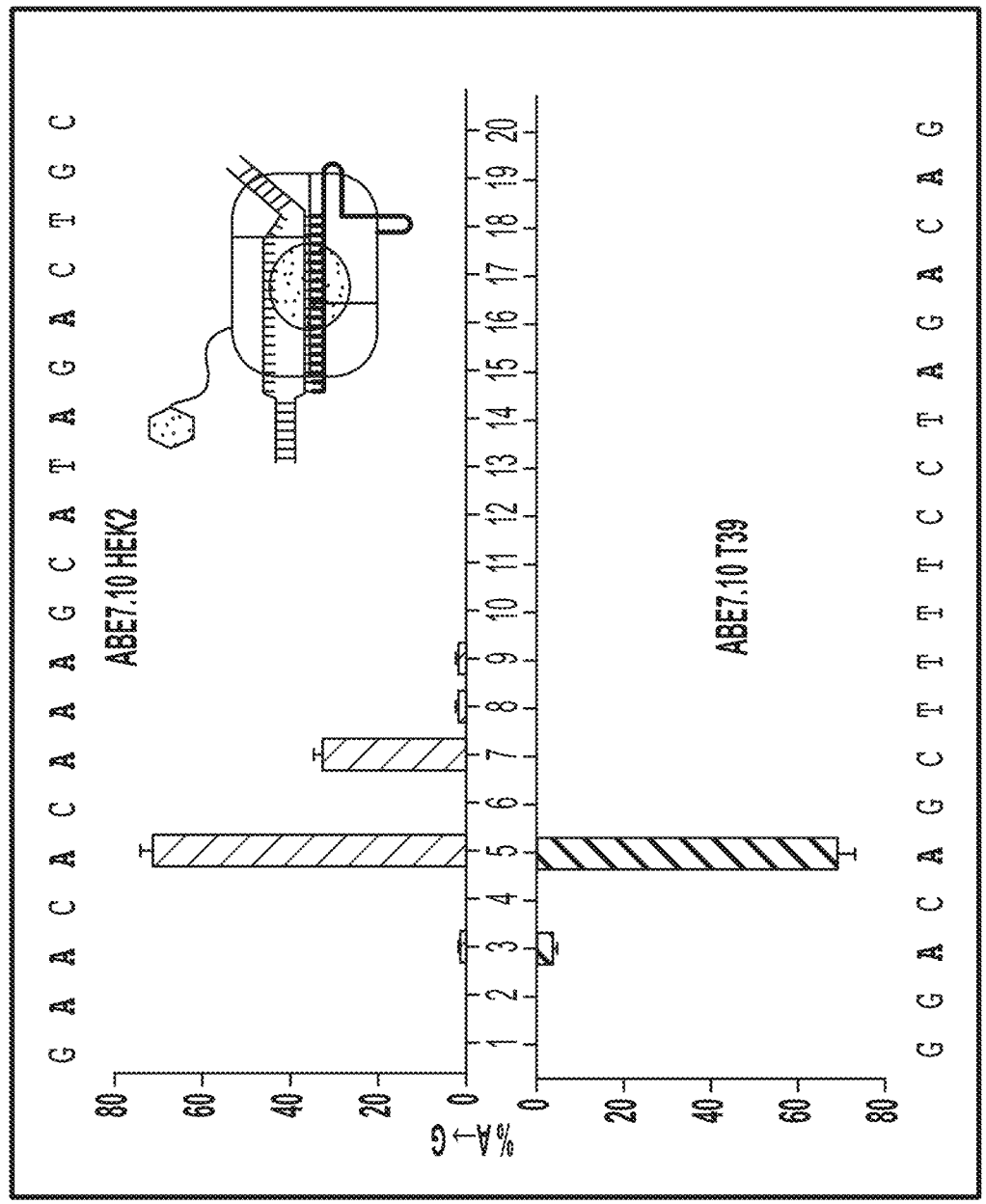
Figure 39:
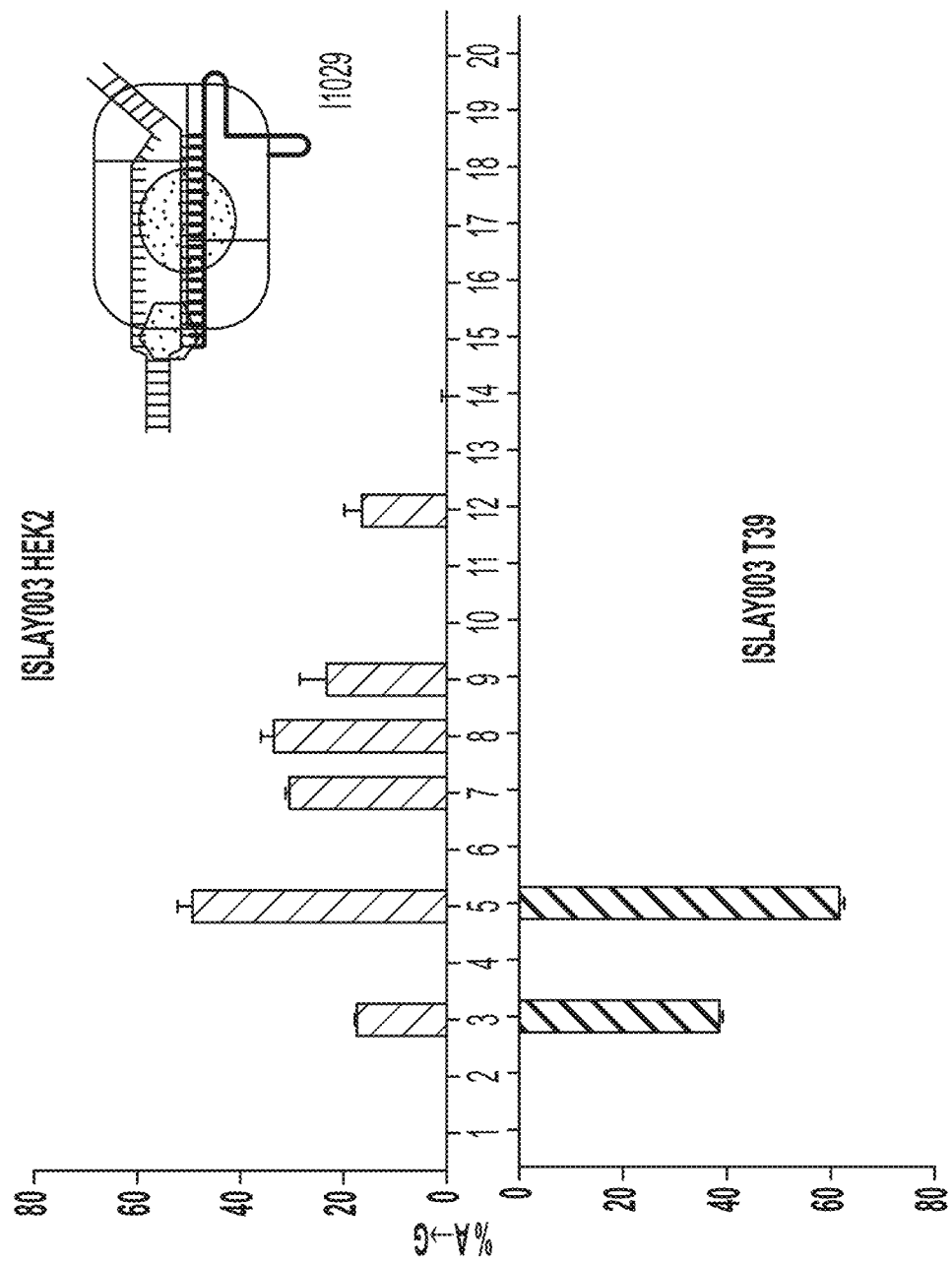
Figure 39:
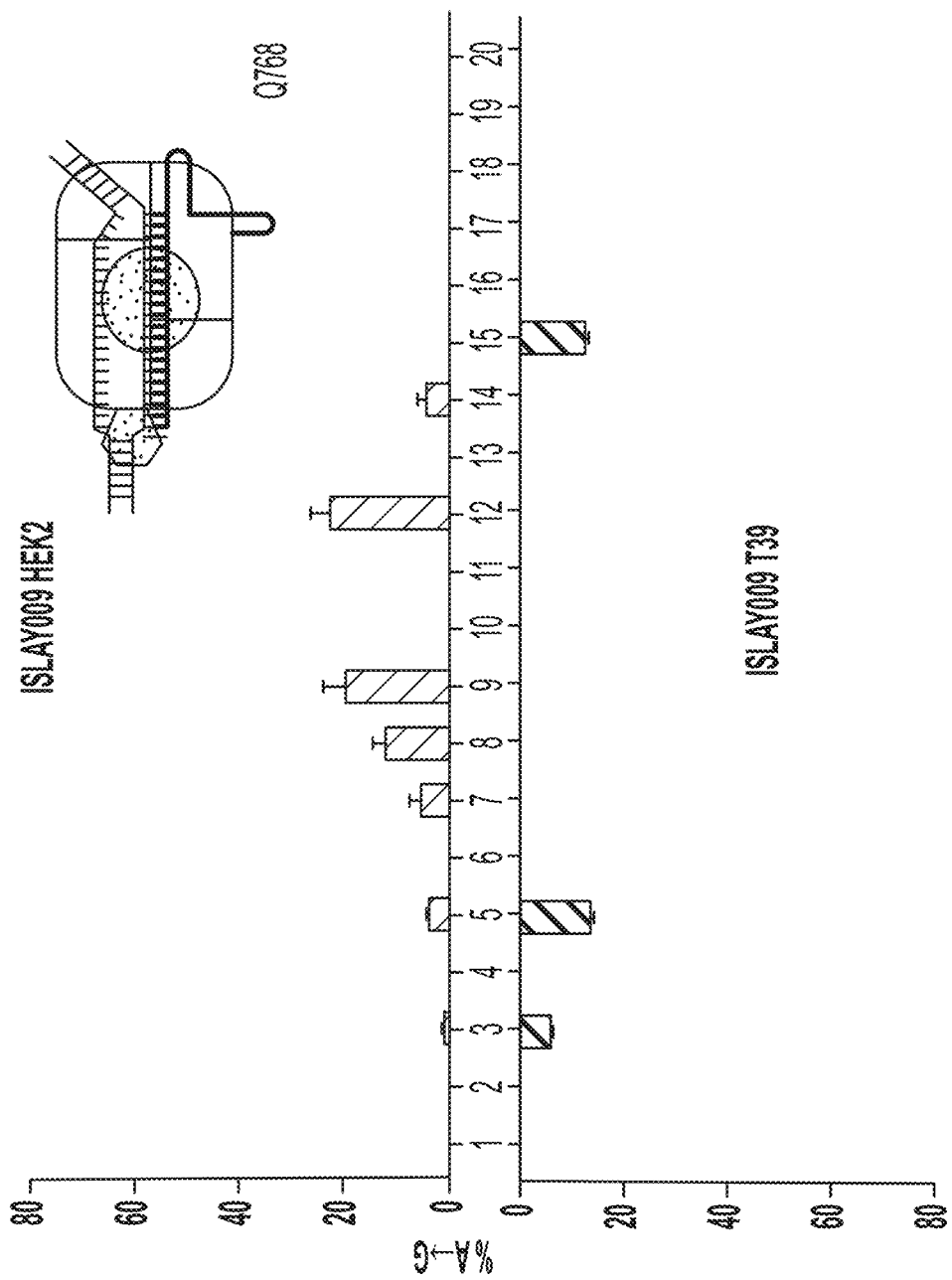

FIGS. 38 and 39 show schematic representations of different adenosine deaminase ISLAY variants that demonstrated increased editing of the target site (as shown in FIG. 37). Schematically shown for comparison in the middle panels are other ABE editors (ABE7.10) with a linker to the TadA domain. FIGS. 38 and 39 disclose SEQ ID NOS 303-304, respectively, in order of appearance.

Figure 40:
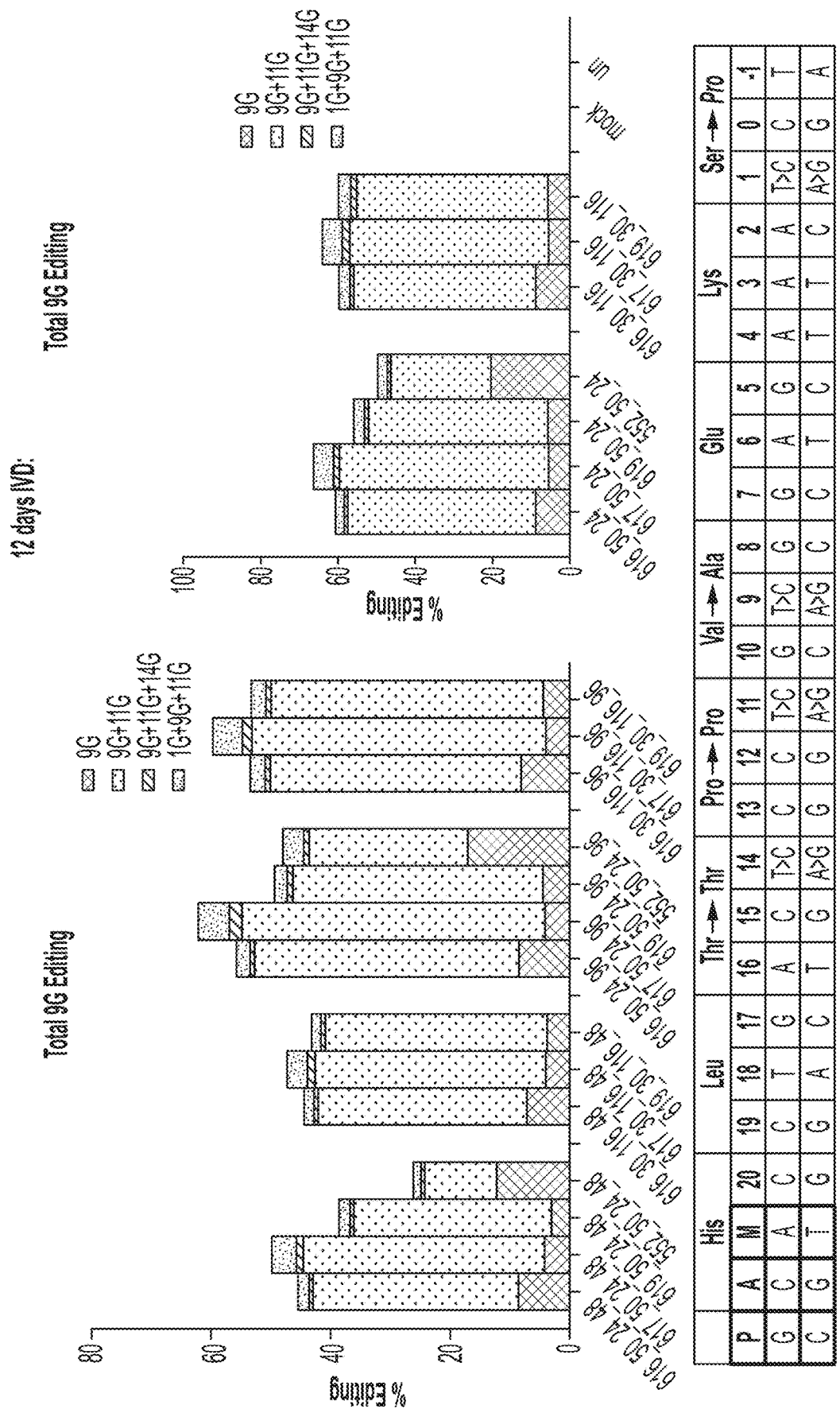

FIG. 40 shows bar graphs depicting percentage of base editing achieved in CD34+ cells that expressed the SCD target site and a table showing edited nucleic acids and amino acid changes. CD34+ cells from a heterozygous sickle trait patient were treated with ABE editors and editing of the target site (9G), i.e., conversion of nucleobase A to nucleobase T to achieve the desired correction of the Val>Ala, was measured. Greater than 50% editing of the sickle cell allele by the variant ABE editors was achieved in the CD34+ cells at 96 hours post electroporation. This was sustained after the cells had differentiated into red blood cells in vitro (IVD), as greater than 60% editing was shown in differentiated erythroid cells (heterozygous for sickle trait) 12 days after erythroid differentiation. For the graphs, Editor nM mRNA_[sgRNA]:[mRNA]_Timepoint are evaluated, and 21nt gRNA was utilized. FIG. 40 discloses SEQ ID NOS 305-307, respectively, in order of appearance.

Figure 41A:
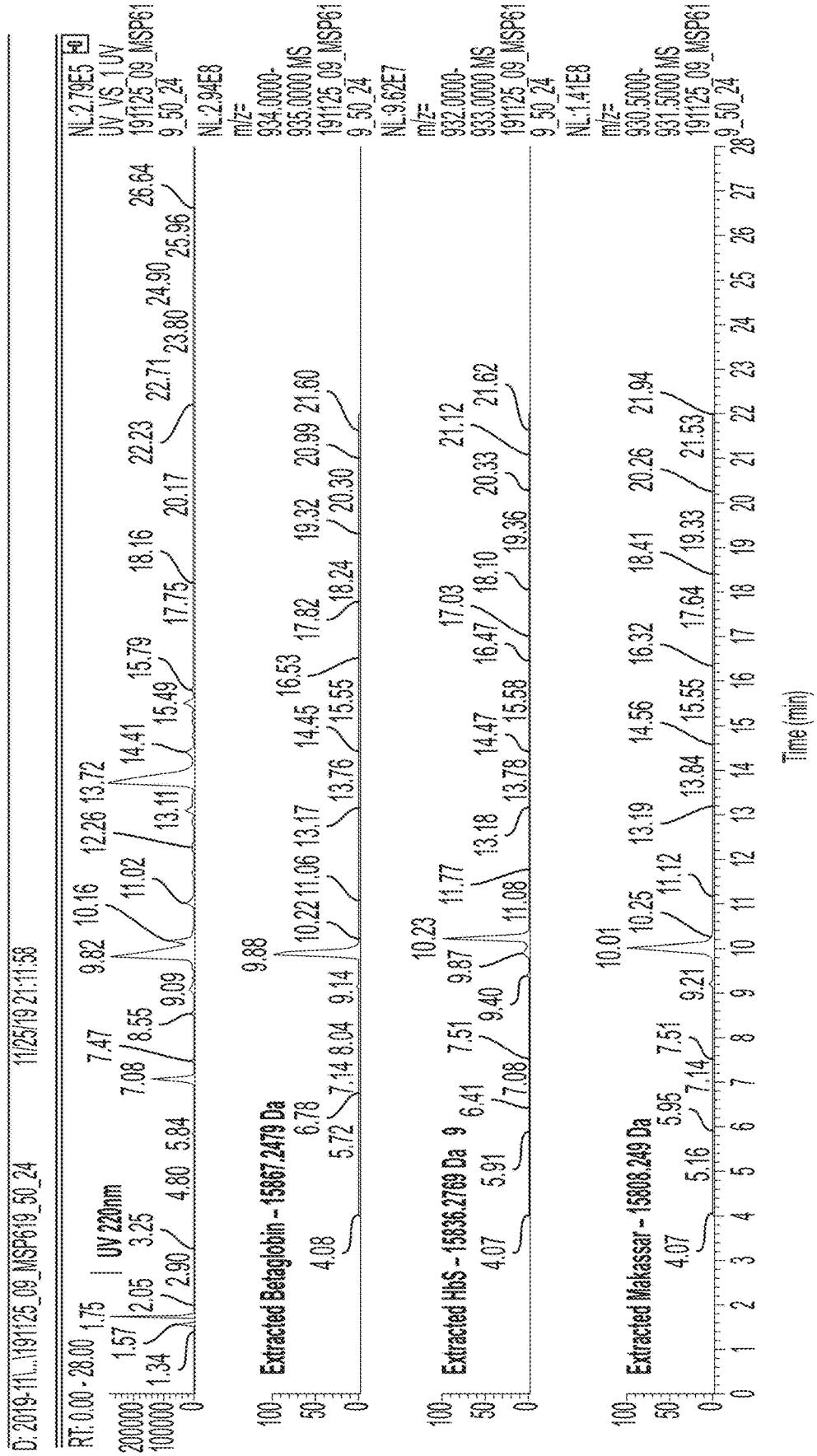
Figure 41B:
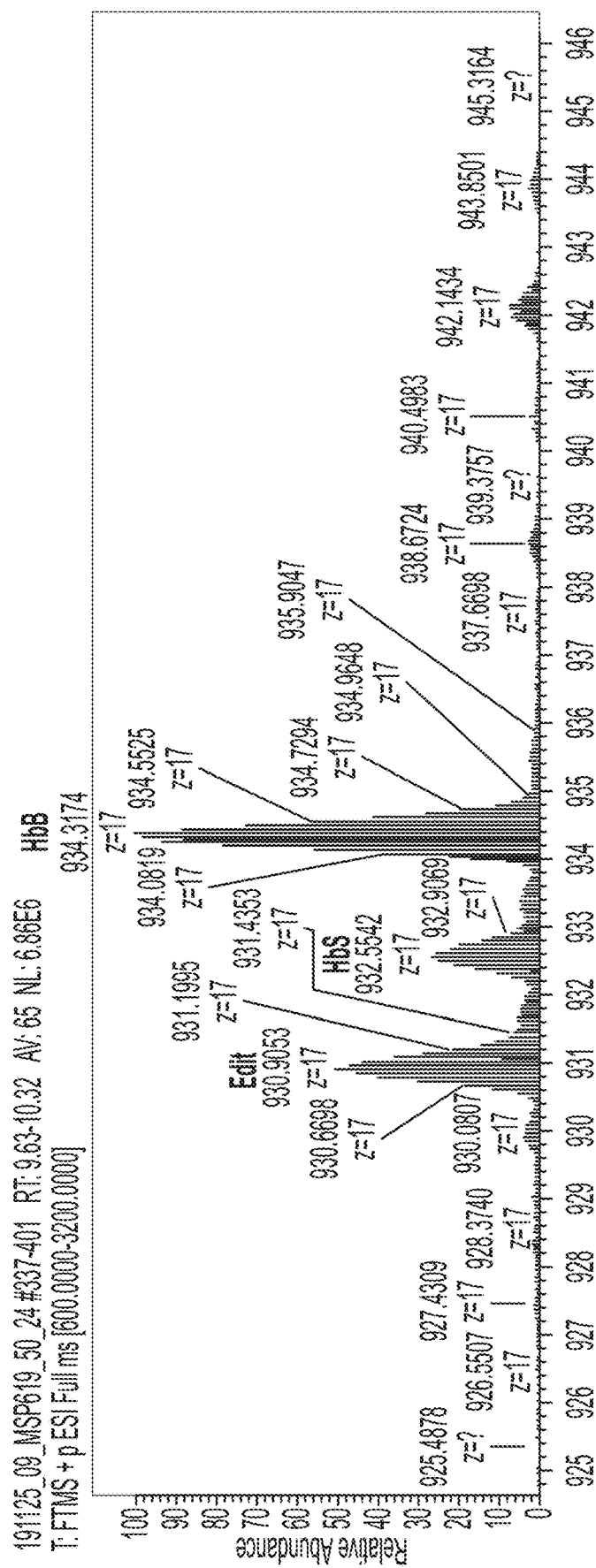

FIGS. 41A and 41B present an ultra-high-performance liquid chromatography (UHPLC) chromatographic trace and LC-MS results related to the detection of distinct β-globin species in edited heterozygous HbS (β-globin in sickle cells) differentiated erythroid cells. Prior to these studies and analyses, discriminating and separating the HbG Makassar variant globin from HbS sickle globin variant using conventional methods were routinely unsuccessful by practitioners in the art. A UHPLC method was developed and used herein to discriminate between these two different globin variants in cells, e.g., CD34+ cells, from SCD patients that had been edited using ABE8 editors as described herein. Following editing of CD34+ cells from a heterozygous HbSS sample, different beta globin (Hb) variants corresponding to those having the Val→Ala substitution could be detected based on molecular weight using UHPLC (FIG. 41A). The edit peak analyzed by Liquid Chromatography-Mass Spectrometry (LC-MS) shows the charge envelope indicating a distinct, new beta globin variant (Makassar variant), (FIG. 41B).

FIG. 42 presents a table of base editors and sgRNA sequences for base editing SCD samples with an HbS globin variant to achieve correction to an HbG Makassar variant globin. ABE8 mutations were introduced into leading editor candidates and sgRNA of different lengths (21nt (SEQ ID NO: 308), 20nt (SEQ ID NO: 309), 19nt (SEQ ID NO: 310) protospacers) were assessed to examine whether on-target editing could be improved while reducing potentially harmful 1G edit (Ser10Pro conversion). The "A" nucleotide in bold/italics/underline depicts the sickle substitution. The lowercase letters in the sgRNA/protospacer sequences indicate nucleobases that are 2'-O-methylated. The lowercase "s" in the sgRNA/protospacer sequences indicates phosphorothioates.

Figure 43A:
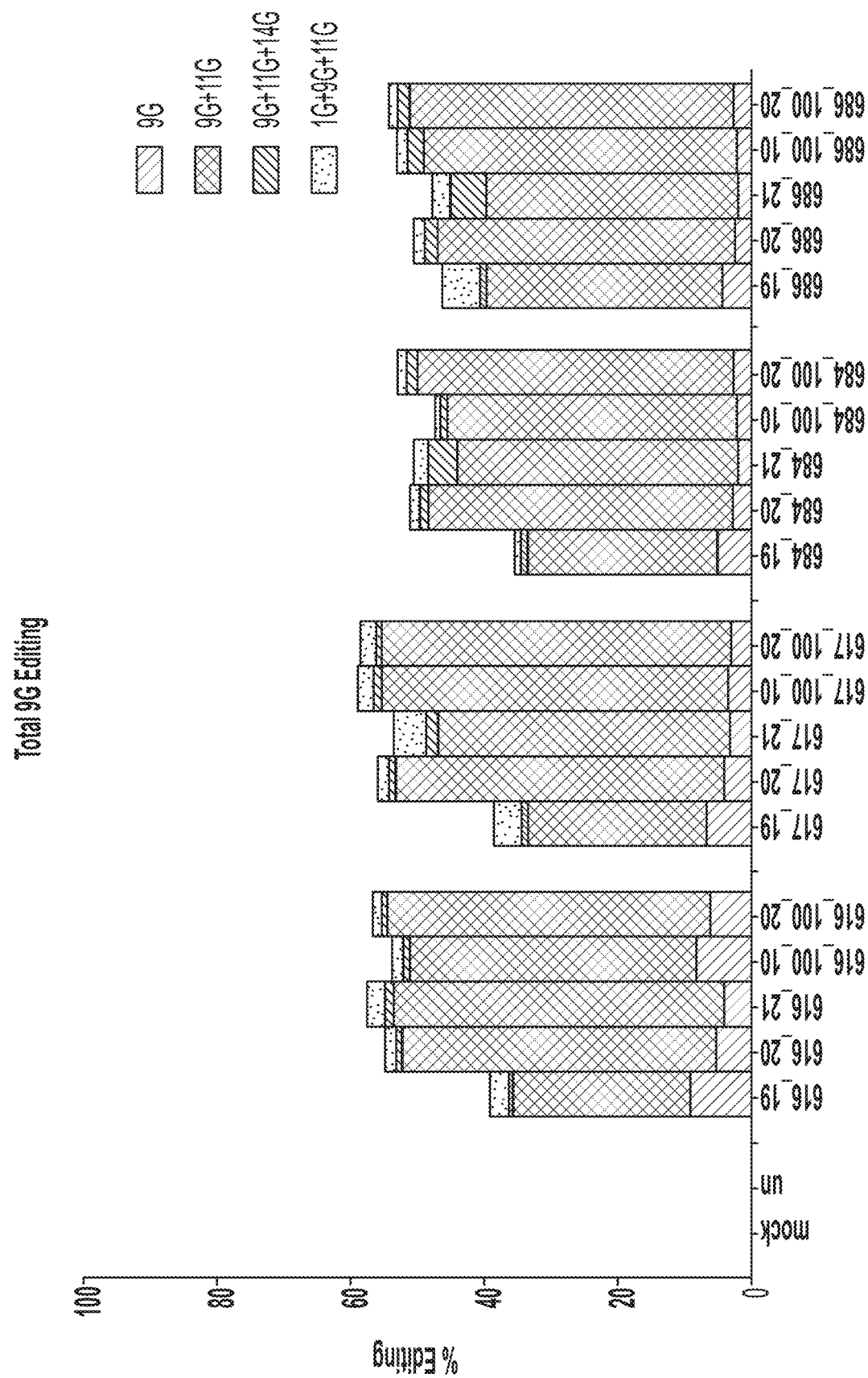

FIGS. 43A and 43B show bar graphs of total percent editing at the 9G target site (or 9G and other sites) in CD34+ cells (heterozygous sickle cell trait sample) by different ABE editors at 48h post electroporation (FIG. 43A) or in in vitro differentiated erythroid cells (heterozygous sickle trait sample) 7d after differentiation (FIG. 43B). While additional mutations did not greatly improve on-target editing, 4 editors demonstrated comparable on-targeting editing efficiency. 20nt sgRNA length achieved lower 1G undesired bystander editing. For these graphs, Editor_sgRNA nt or Editor_100 nM mRNA_µM sgRNA (20nt) are evaluated. Editing was maintained throughout erythroid differentiation in vitro, nearing 80%.

Figure 44A:
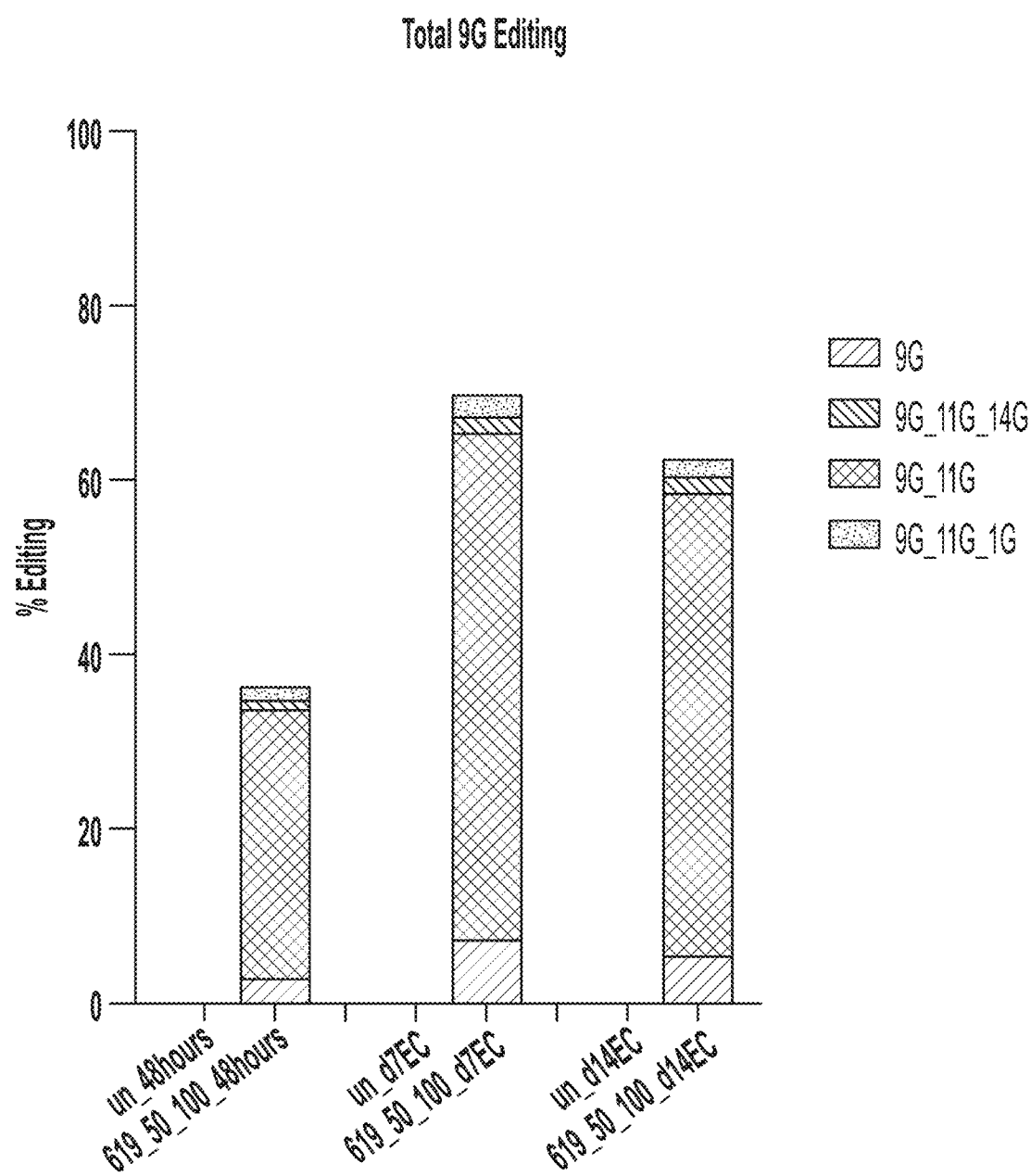
Figure 44B:
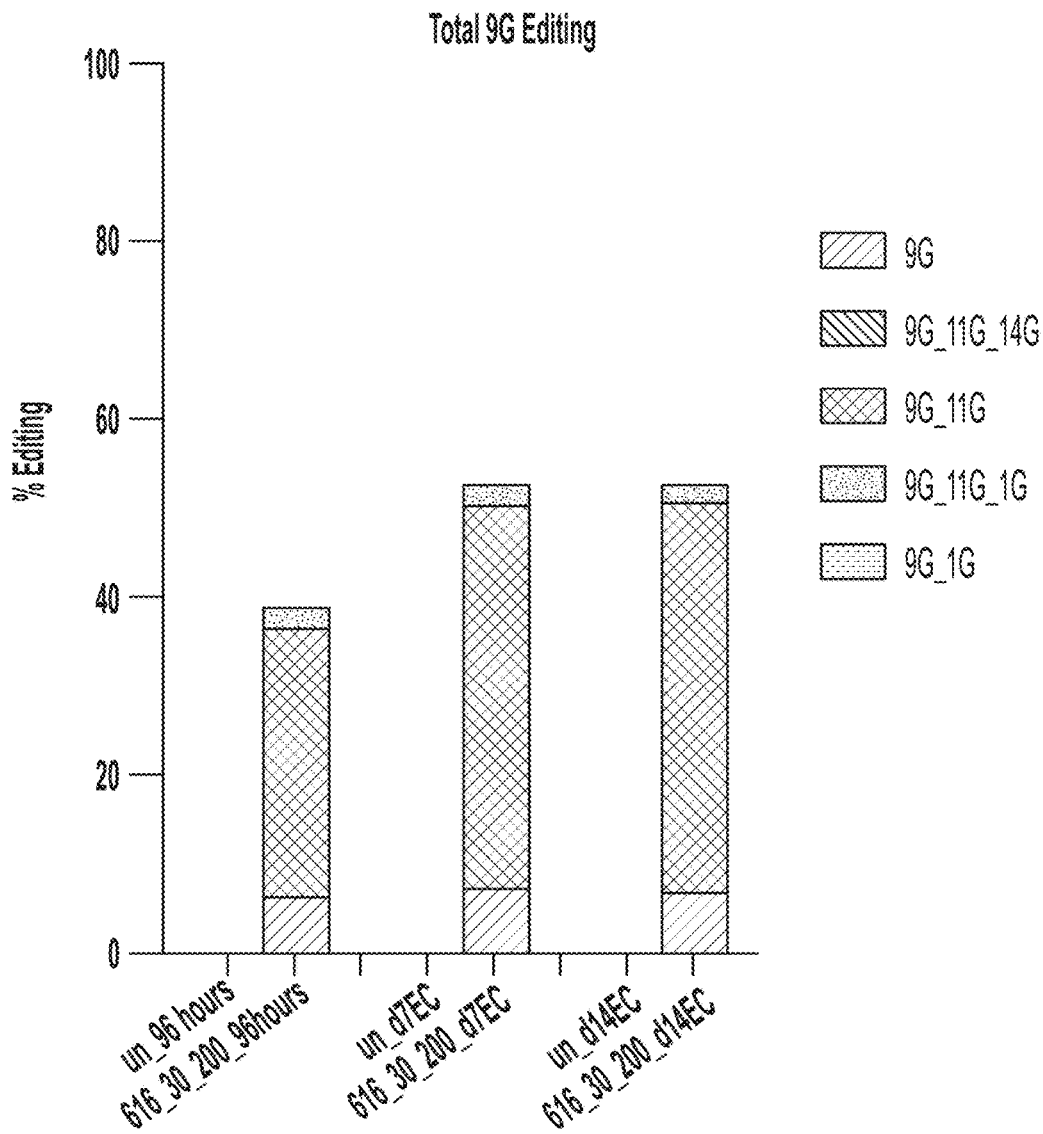

FIGS. 44A and 44B present bar graphs and a table showing edited nucleic acid sequence and corresponding amino acid sequence conversion related to total base editing at position 9G of HbS in homozygous SCD (HbSS) samples. Cells were obtained from a whole blood (non-mobilized) sample from a patient with SCD (HbSS) and subjected to base editing using ABE variant base editors. FIG. 44A: CD34+ cells (~200,000 cells, homozygous SCD sample)) were electroporated with 50 nM ABE variant editor (MSP619 (ISLAY5)) at a 100:1 ratio (2 µg of mRNA, 4.1 µg of sgRNA (21nt)). The ABE variant base editors achieved approximately 65% editing at position 9G in the cells at 7d following electroporation, and about 60% editing at position 9G at 14d following electroporation. FIG. 44B: CD34+ cells (~200,000 cells, homozygous SCD sample)) were electroporated with 30 nM ABE variant editor (MSP616 (ISLAY2)) at a 200:1 ratio (1.3 µg of mRNA, 4.95 µg of sgRNA (21nt)). The ABE variant base editors achieved at least approximately 50% editing at position 9G in the erythroid cells at 7d and 14 d following electroporation. FIG. 44B discloses SEQ ID NOS 305-307, respectively, in order of appearance.

Figure 45:
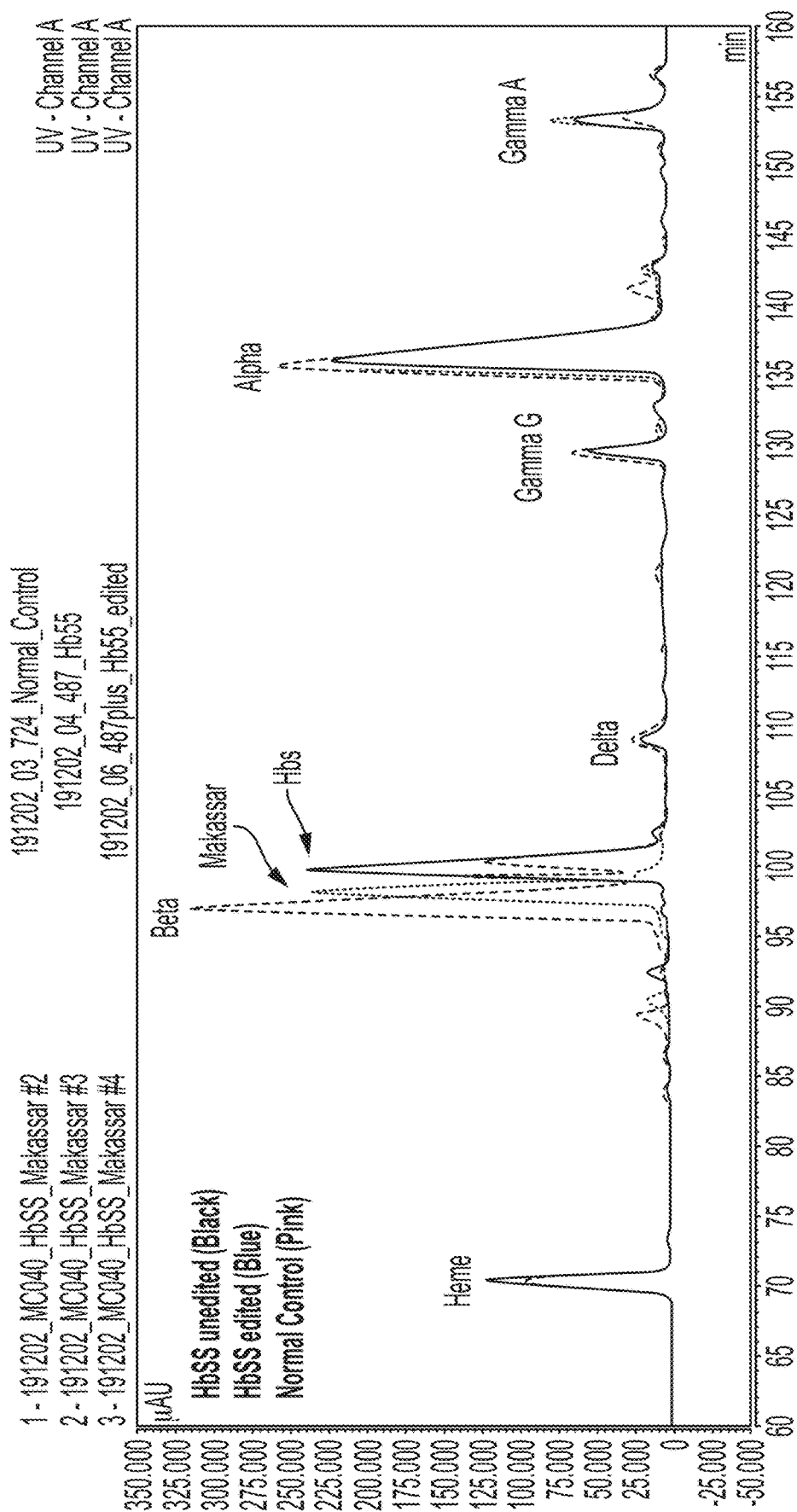

FIG. 45 presents a UHPLC chromatographic trace following UHPLC analysis, which shows a clear separation of and discrimination between the HbS form and the HbG Makassar variant forms of globin proteins following base editing using ABE variant base editors in homozygous HbSS cells obtained from a SCD patient sample.

Figure 46B:
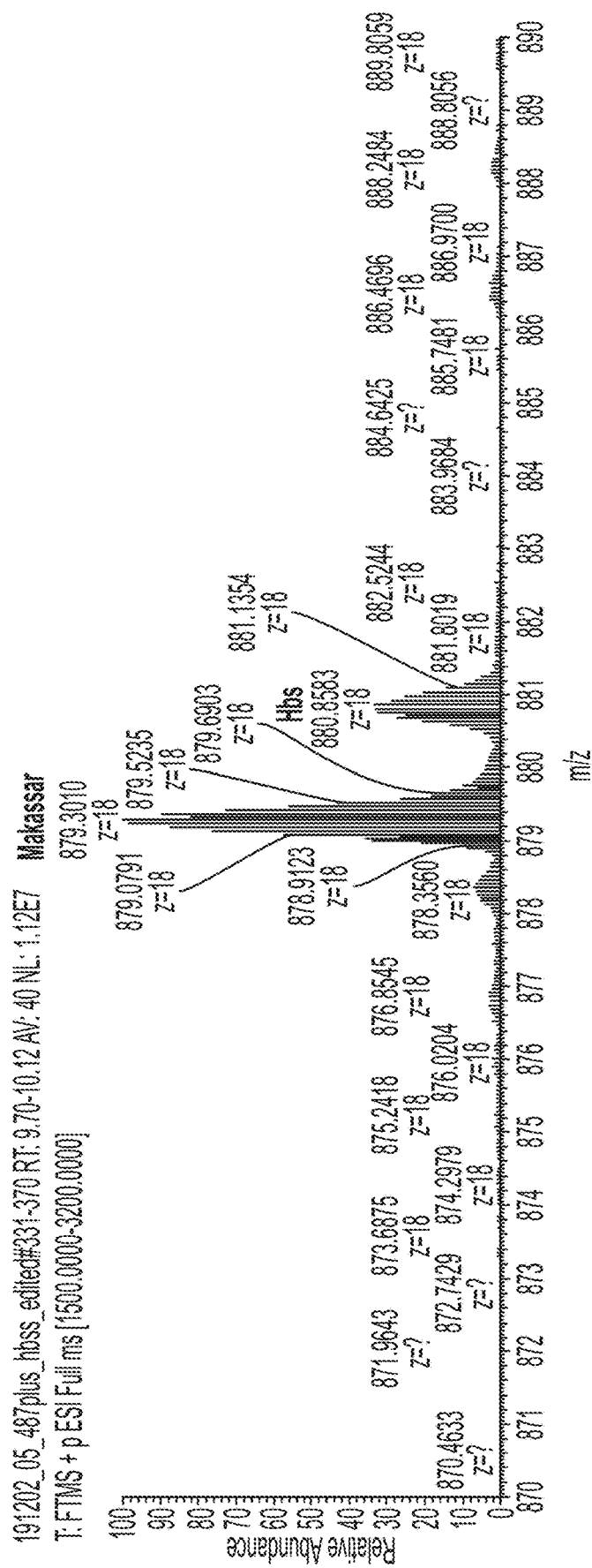

FIGS. 46A and 46B present a UHPLC chromatographic trace and LC-MS results related to the detection of distinct β-globin species in edited heterozygous HbS (β-globin in sickle cells) differentiated erythroid cells. As described for FIGS. 41A and 41B, UHPLC was used to discriminate these two different globin variants. In an edited heterozygous HbSS sample, different beta globin (Hb) variants corresponding to those having the Val→Ala substitution could be detected based on molecular weight (FIG. 46A). The edit peak in the LC-MS trace shows the charge envelope indicating a new beta globin variant (FIG. 46B).

Figure 47:
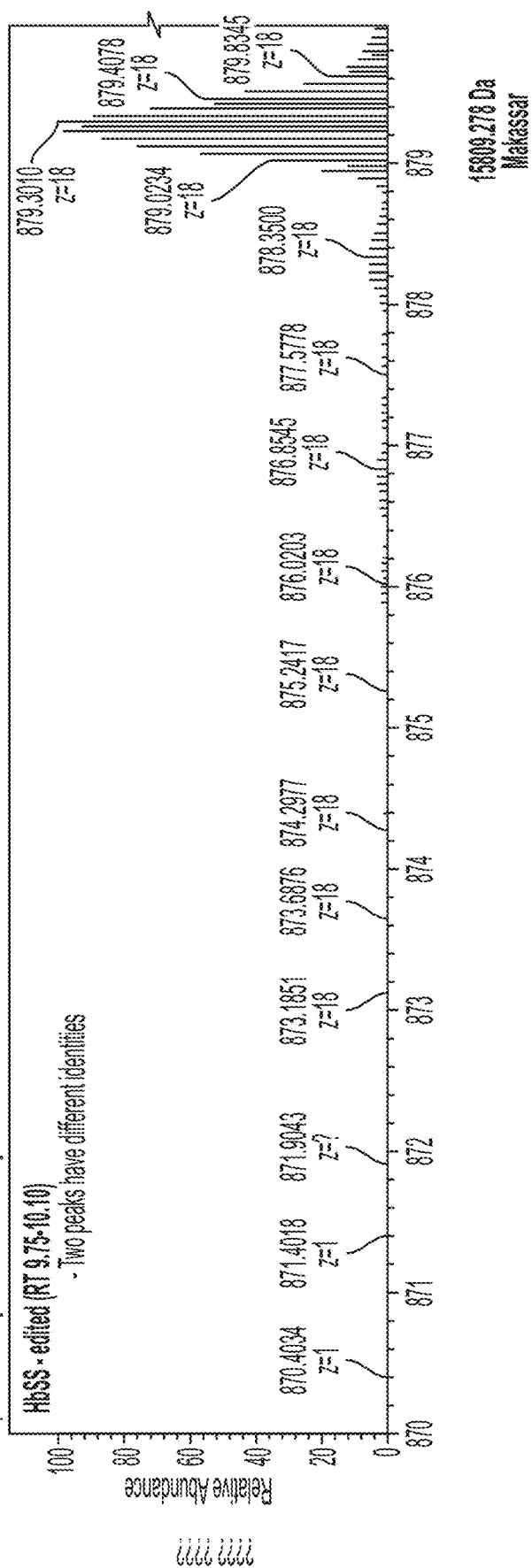
Figure 47:
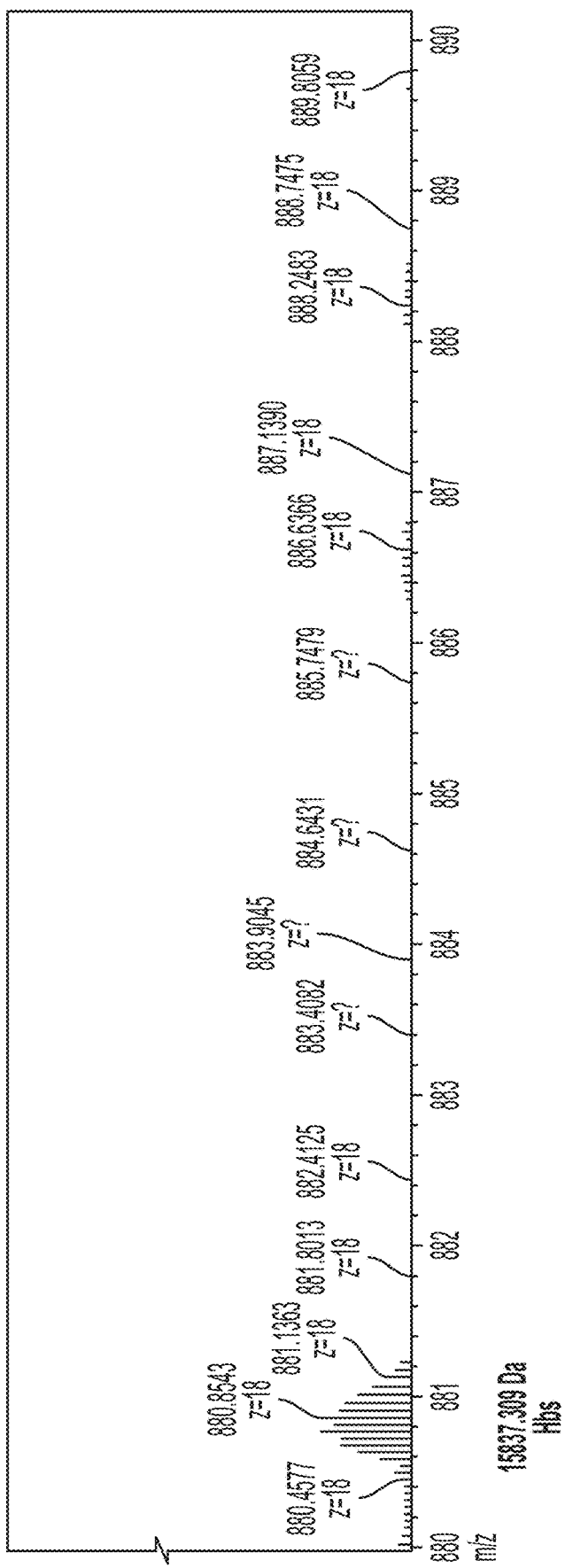

FIG. 47 shows UHPLC chromatographic traces and LC-MS results of HbSS (SCD) samples subjected to base editing ("HbSS-edited") or not subjected to base editing ("HbSS-unedited"). As shown in the top and middle UHPLC chromatographs, the HbG Makassar globin variant (at 9.81 min) is distinguished from the HbS (SCD) globin form (10.03 min) based on elution time differentials on UHPLC. The other globin forms are readily distinguished. In the bottom LC-MS graph, the Makassar HbG variant and the HbS form of globin have different and distinguishable identities. Similar to the results presented for FIGS. 41A, 41B, 45, 46A and 46B, the UHPLC and LC-MS analyses of cells from SCD (HbSS) erythroid cell samples edited with the ABE variant base editors described herein provide clear identification and separation of the HbG Makassar variant and the HbS (SCD) globin variant in the samples, thus providing a beneficial means of identifying authentic SCD (HbS) patients and of alleviating or preventing misdiagnosis of SCD (HbSS) in patients who instead present with the HbG Makassar globin variant.

Figure 48C:
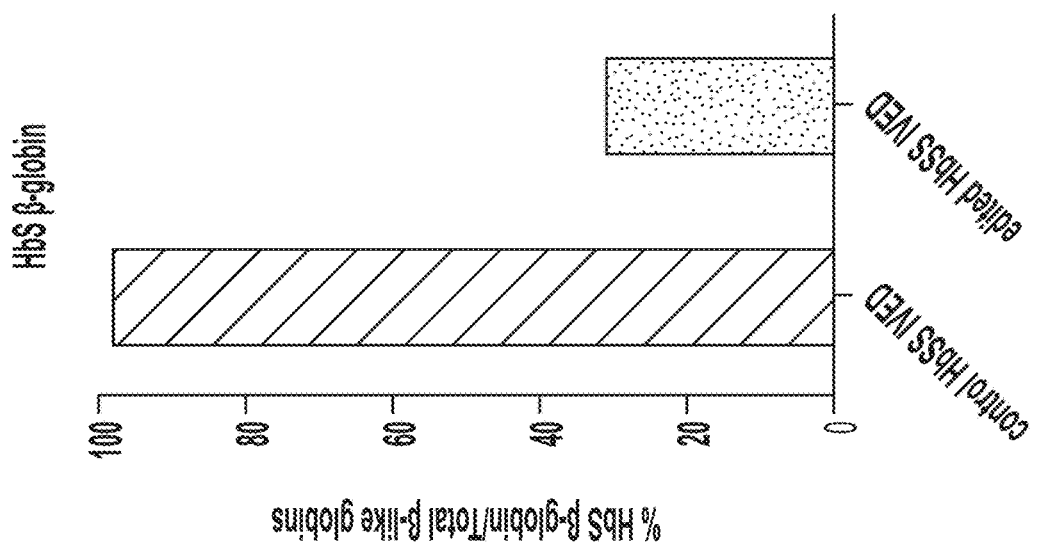
Figure 48B:
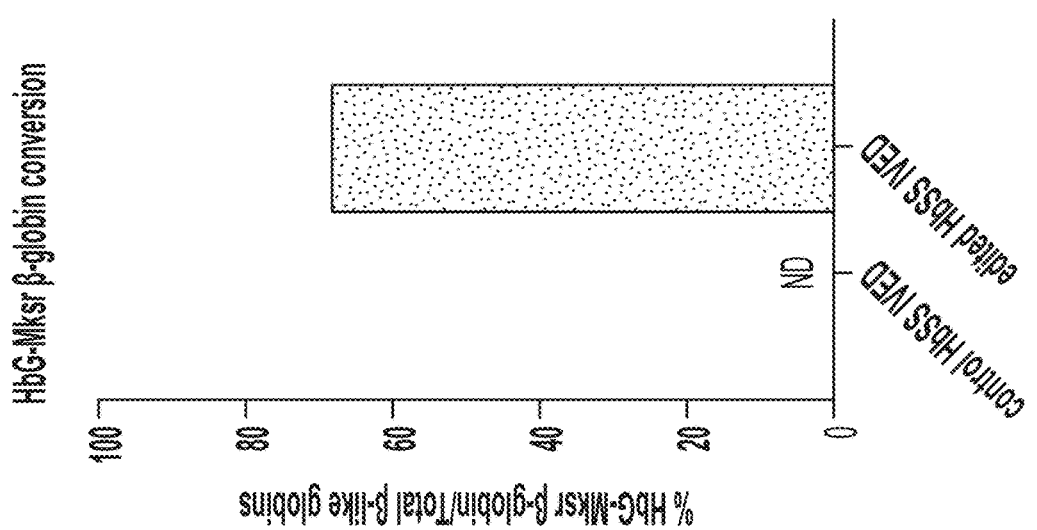
Figure 48A:
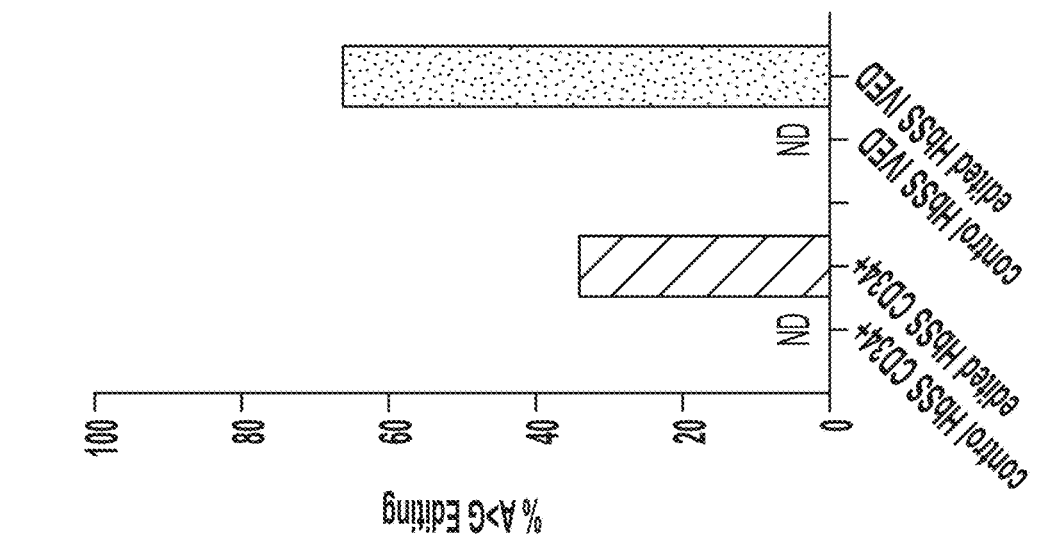

FIGS. 48A-48C show bar graphs representing relative areas under the peaks of UHPLC chromatography data. The area under the peaks was used to quantify the total change in amount of the different β-globin variants in a homozygous SCD sample that had been subjected to base editing employing an ABE variant of the invention. (Base Editor MSP619, 50 nM mRNA, 5000 nM sgRNA (21nt)). The results presented suggest that the levels of conversion of the HbS variant globin to the asymptomatic HbG-Makassar globin are directly correlated.

FIG. 49 is a table depicting Cas9 variants for accessing all possible PAMs within the NRNN PAM space. Only Cas9 variants that require recognition of three or fewer defined nucleotides in their PAMs are listed. The non-G PAM variants include SpCas9-NRRH, SpCas9-NRTH, and SpCas9-NRCH. (Miller, S. M., et al. Continuous evolution of SpCas9 variants compatible with non-G PAMs, Nat. Biotechnol. (2020), (///doi.org/10.1038/s41587-020-0412-8), the contents of which are incorporated herein by reference in their entirety.

DETAILED DESCRIPTION OF THE INVENTION

As described below, the present invention features compositions and methods for altering mutations associated with sickle cell disease (SCD). In some embodiments, the editing corrects a deleterious mutation, such that the edited polynucleotide is indistinguishable from a wild-type reference polynucleotide sequence. In another embodiment, the editing alters the deleterious mutation, such that the edited polynucleotide comprises a benign mutation.

HBB Gene Editing

As described herein, the compositions and methods of the invention are useful and advantageous for the treatment of sickle cell disease (SCD), which is caused by a Glu→Val mutation at the sixth amino acid of the β-globin protein encoded by the HBB gene. Despite many developments to date in the field of gene editing, precise correction of the diseased HBB gene to revert Val→Glu remains elusive and is presently not achievable using either CRISPR/Cas nuclease or CRISPR/Cas base editing approaches.

Genome editing of the HBB gene to replace the affected nucleotide using a CRISPR/Cas nuclease approach requires cleavage of genomic DNA. However, cleavage of genomic DNA carries an increased risk of generating base insertions/deletions (indels), which have the potential to cause unintended and undesirable consequences, including generating premature stop codons, altering the codon reading frame, etc. Furthermore, generating double-stranded breaks at the β-globin locus has the potential to radically alter the locus through recombination events. The β-globin locus contains a cluster of globin genes having sequence identity to one another—5'-ε-; Gγ-; Aγ-; δ-; and β-globin-3'. Because of the structure of the β-globin locus, recombination repair of a double-stranded break within the locus has the potential to result in gene loss of intervening sequences between globin genes, for example between δ- and β-globin genes.

Unintended alterations to the locus also carry a risk of causing thalassemia. CRISPR/Cas base editing approaches hold promise in that they have the ability to generate precise alterations at the nucleobase level. However, precise correction of Val 4 Glu (G$\underline{T}$G→G$\underline{A}$G) requires a T•A to A•T transversion editor, which is not presently known to exist. Additionally, the specificity of CRISPR/Cas base editing is due in part to a limited window of editable nucleotides created by R-loop formation upon CRISPR/Cas binding to DNA. Thus, CRISPR/Cas targeting must occur at or near the sickle cell site to allow base editing to be possible, and there may be additional sequence requirements for optimal editing within the window. One requirement for CRISPR/Cas targeting is the presence of a protospacer-adjacent motif (PAM) flanking the site to be targeted. For example, many base editors are based on SpCas9 which requires an NGG PAM. Even assuming hypothetically that an T•A to A•T transversion were possible, no NGG PAM exists that would place the target "A" at a desirable position for such an SpCas9 base editor. Although many new CRISPR/Cas proteins have been discovered or generated that expand the collection of available PAMs, PAM requirements remain a limiting factor in the ability to direct CRISPR/Cas base editors to specific nucleotides at any location in the genome.

The present invention is based, at least in part, on several discoveries described herein that address the foregoing challenges for providing a genome editing approach for treatment of sickle cell anemia. In one aspect, the invention is based in part on the ability to replace the valine at amino acid position 6, which causes sickle cell disease, with an alanine, to thereby generate an Hb variant (Hb Makassar) that does not generate a sickle cell phenotype. While precise correction (GTG→GAG) is not possible without a T•A to A•T transversion base editor, the studies performed herein have found that a Val→Ala (GTG→GCG) replacement (i.e., the Hb Makassar variant) can be generated using an A•T to G•C base editor (ABE). This was achieved in part by the development of novel base editors and novel base editing strategies, as provided herein. For example, novel ABE base editors (i.e., having an adenosine deaminase domain) that utilize flanking sequences (e.g., PAM sequences; zinc finger binding sequences) for optimal base editing at the sickle cell target site.

Thus, the present invention includes compositions and methods for base editing a thymidine (T) to a cytidine (C) in the codon of the sixth amino acid of a sickle cell disease variant of the β-globin protein (Sickle HbS; E6V), thereby substituting an alanine for a valine (V6A) at this amino acid position. Substitution of alanine for valine at position 6 of HbS generates a β-globin protein variant that does not have a sickle cell phenotype (e.g., does not have the potential to polymerize as in the case of the pathogenic variant HbS). Accordingly, the compositions and methods of the invention are useful for the treatment of sickle cell disease (SCD).

Nucleobase Editor

Disclosed herein is a base editor or a nucleobase editor for editing, modifying or altering a target nucleotide sequence of a polynucleotide (e.g., HBB polynucleotide). Described herein is a nucleobase editor or a base editor comprising a polynucleotide programmable nucleotide binding domain and a nucleobase editing domain (e.g., adenosine deaminase). A polynucleotide programmable nucleotide binding domain, when in conjunction with a bound guide polynucleotide (e.g., gRNA), can specifically bind to a target polynucleotide sequence (i.e., via complementary base pairing between bases of the bound guide nucleic acid and bases of the target polynucleotide sequence) and thereby localize the base editor to the target nucleic acid sequence desired to be edited. In some embodiments, the target polynucleotide sequence comprises single-stranded DNA or double-stranded DNA. In some embodiments, the target polynucleotide sequence comprises RNA. In some embodiments, the target polynucleotide sequence comprises a DNA-RNA hybrid.

Polynucleotide Programmable Nucleotide Binding Domain

It should be appreciated that polynucleotide programmable nucleotide binding domains can also include nucleic acid programmable proteins that bind RNA. For example, the polynucleotide programmable nucleotide binding domain can be associated with a nucleic acid that guides the polynucleotide programmable nucleotide binding domain to an RNA. Other nucleic acid programmable DNA binding proteins are also within the scope of this disclosure, though they are not specifically listed in this disclosure.

A polynucleotide programmable nucleotide binding domain of a base editor can itself comprise one or more domains. For example, a polynucleotide programmable nucleotide binding domain can comprise one or more nuclease domains. In some embodiments, the nuclease domain of a polynucleotide programmable nucleotide binding domain can comprise an endonuclease or an exonuclease. Herein the term "exonuclease" refers to a protein or polypeptide capable of digesting a nucleic acid (e.g., RNA or DNA) from free ends, and the term "endonuclease" refers to a protein or polypeptide capable of catalyzing (e.g., cleaving) internal regions in a nucleic acid (e.g., DNA or RNA). In some embodiments, an endonuclease can cleave a single strand of a double-stranded nucleic acid. In some embodiments, an endonuclease can cleave both strands of a double-stranded nucleic acid molecule. In some embodiments a polynucleotide programmable nucleotide binding domain can be a deoxyribonuclease. In some embodiments a polynucleotide programmable nucleotide binding domain can be a ribonuclease.

In some embodiments, a nuclease domain of a polynucleotide programmable nucleotide binding domain can cut zero, one, or two strands of a target polynucleotide. In some embodiments, the polynucleotide programmable nucleotide binding domain can comprise a nickase domain. Herein the term "nickase" refers to a polynucleotide programmable nucleotide binding domain comprising a nuclease domain that is capable of cleaving only one strand of the two strands in a duplexed nucleic acid molecule (e.g., DNA). In some embodiments, a nickase can be derived from a fully catalytically active (e.g., natural) form of a polynucleotide programmable nucleotide binding domain by introducing one or more mutations into the active polynucleotide programmable nucleotide binding domain. For example, where a polynucleotide programmable nucleotide binding domain comprises a nickase domain derived from Cas9, the Cas9-derived nickase domain can include a D10A mutation and a histidine at position 840. In such cases, the residue H840 retains catalytic activity and can thereby cleave a single strand of the nucleic acid duplex. In another example, a Cas9-derived nickase domain can comprise an H840A mutation, while the amino acid residue at position 10 remains a D. In some embodiments, a nickase can be derived from a fully catalytically active (e.g., natural) form of a polynucleotide programmable nucleotide binding domain by removing all or a portion of a nuclease domain that is not required for the nickase activity. For example, where a polynucleotide programmable nucleotide binding domain comprises a nickase domain derived from Cas9, the Cas9-derived nickase domain can comprise a deletion of all or a portion of the RuvC domain or the HNH domain.

The amino acid sequence of an exemplary catalytically active Cas9 is as follows:

(SEQ ID NO: 1)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

-continued

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD.

A base editor comprising a polynucleotide programmable nucleotide binding domain comprising a nickase domain is thus able to generate a single-strand DNA break (nick) at a specific polynucleotide target sequence (e.g., determined by the complementary sequence of a bound guide nucleic acid). In some embodiments, the strand of a nucleic acid duplex target polynucleotide sequence that is cleaved by a base editor comprising a nickase domain (e.g., Cas9-derived nickase domain) is the strand that is not edited by the base editor (i.e., the strand that is cleaved by the base editor is opposite to a strand comprising a base to be edited). In other embodiments, a base editor comprising a nickase domain (e.g., Cas9-derived nickase domain) can cleave the strand of a DNA molecule which is being targeted for editing. In such cases, the non-targeted strand is not cleaved.

Also provided herein are base editors comprising a polynucleotide programmable nucleotide binding domain which is catalytically dead (i.e., incapable of cleaving a target polynucleotide sequence). Herein the terms "catalytically dead" and "nuclease dead" are used interchangeably to refer to a polynucleotide programmable nucleotide binding domain which has one or more mutations and/or deletions resulting in its inability to cleave a strand of a nucleic acid. In some embodiments, a catalytically dead polynucleotide programmable nucleotide binding domain base editor can lack nuclease activity as a result of specific point mutations in one or more nuclease domains. For example, in the case of a base editor comprising a Cas9 domain, the Cas9 can comprise both a D10A mutation and an H840A mutation. Such mutations inactivate both nuclease domains, thereby resulting in the loss of nuclease activity. In other embodiments, a catalytically dead polynucleotide programmable nucleotide binding domain can comprise one or more deletions of all or a portion of a catalytic domain (e.g., RuvC1 and/or HNH domains). In further embodiments, a catalytically dead polynucleotide programmable nucleotide binding domain comprises a point mutation (e.g., D10A or H840A) as well as a deletion of all or a portion of a nuclease domain.

Also contemplated herein are mutations capable of generating a catalytically dead polynucleotide programmable nucleotide binding domain from a previously functional version of the polynucleotide programmable nucleotide binding domain. For example, in the case of catalytically dead Cas9 ("dCas9"), variants having mutations other than D10A and H840A are provided, which result in nuclease inactivated Cas9. Such mutations, by way of example, include other amino acid substitutions at D10 and H840, or other substitutions within the nuclease domains of Cas9 (e.g., substitutions in the HNH nuclease subdomain and/or the RuvC1 subdomain). Additional suitable nuclease-inactive dCas9 domains can be apparent to those of skill in the art based on this disclosure and knowledge in the field and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

Non-limiting examples of a polynucleotide programmable nucleotide binding domain which can be incorporated into a base editor include a CRISPR protein-derived domain, a restriction nuclease, a meganuclease, TAL nuclease (TALEN), and a zinc finger nuclease (ZFN). In some embodiments, a base editor comprises a polynucleotide programmable nucleotide binding domain comprising a natural or modified protein or portion thereof which via a bound guide nucleic acid is capable of binding to a nucleic acid sequence during CRISPR (i.e., Clustered Regularly Interspaced Short Palindromic Repeats)-mediated modification of a nucleic acid. Such a protein is referred to herein as a "CRISPR protein." Accordingly, disclosed herein is a base editor comprising a polynucleotide programmable nucleotide binding domain comprising all or a portion of a CRISPR protein (i.e. a base editor comprising as a domain all or a portion of a CRISPR protein, also referred to as a "CRISPR protein-derived domain" of the base editor). A CRISPR protein-derived domain incorporated into a base editor can be modified compared to a wild-type or natural version of the CRISPR protein. For example, as described below a CRISPR protein-derived domain can comprise one or more mutations, insertions, deletions, rearrangements and/or recombinations relative to a wild-type or natural version of the CRISPR protein.

CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems, correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, and then trimmed 3'-5' exonucleolytically. In nature, DNA-binding and cleavage typically requires protein and both RNAs. However, single guide RNAs ("sgRNA," or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. Science 337:816-821 (2012), the entire contents of which is hereby incorporated by reference. Cas9 recognizes a short motif in the CRISPR repeat sequences (the PAM or protospacer adjacent motif) to help distinguish self versus non-self.

In some embodiments, the methods described herein can utilize an engineered Cas protein. A guide RNA (gRNA) is a short synthetic RNA composed of a scaffold sequence necessary for Cas-binding and a user-defined ~20 nucleotide spacer that defines the genomic target to be modified. Thus, a skilled artisan can change the genomic target of the Cas protein specificity is partially determined by how specific the gRNA targeting sequence is for the genomic target compared to the rest of the genome.

In some embodiments, the gRNA scaffold sequence is as follows: GUUUUAGAGC UAGAAAUAGC AAGUUAAAAU AAGGCUAGUC CGUUAUCAAC UUGAAAAAGU GGCACCGAGU CGGUGCUUUU (SEQ ID NO: 78).

In some embodiments, a CRISPR protein-derived domain incorporated into a base editor is an endonuclease (e.g., deoxyribonuclease or ribonuclease) capable of binding a target polynucleotide when in conjunction with a bound guide nucleic acid. In some embodiments, a CRISPR protein-derived domain incorporated into a base editor is a nickase capable of binding a target polynucleotide when in conjunction with a bound guide nucleic acid. In some embodiments, a CRISPR protein-derived domain incorporated into a base editor is a catalytically dead domain capable of binding a target polynucleotide when in conjunction with a bound guide nucleic acid. In some embodiments, a target polynucleotide bound by a CRISPR protein derived domain of a base editor is DNA. In some embodiments, a target polynucleotide bound by a CRISPR protein-derived domain of a base editor is RNA.

Cas proteins that can be used herein include class 1 and class 2. Non-limiting examples of Cas proteins include Cas1, Cas1B, Cas2, Cas3, Cas4, Cas5, Cas5d, Cas5t, Cas5h, Cas5a, Cas6, Cas7, Cas8, Cas9 (also known as Csn1 or Csx12), Cas10, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csf1, Csf2, CsO, Csf4, Csd1, Csd2, Cst1, Cst2, Csh1, Csh2, Csa1, Csa2, Csa3, Csa4, Csa5, Cas12a/Cpf1, Cas12b/C2c1, Cas12c/C2c3, Cas12d/CasY, Cas12e/CasX, Cas12g, Cas12h, and Cas12i, CARF, DinG, homologues thereof, or modified versions thereof. An unmodified CRISPR enzyme can have DNA cleavage activity, such as Cas9, which has two functional endonuclease domains: RuvC and HNH. A CRISPR enzyme can direct cleavage of one or both strands at a target sequence, such as within a target sequence and/or within a complement of a target sequence. For example, a CRISPR enzyme can direct cleavage of one or both strands within about 1, 2, 3, 4, 5, 6, 7, 8, 9, 10, 15, 20, 25, 50, 100, 200, 500, or more base pairs from the first or last nucleotide of a target sequence.

A vector that encodes a CRISPR enzyme that is mutated to with respect, to a corresponding wild-type enzyme such that the mutated CRISPR enzyme lacks the ability to cleave one or both strands of a target polynucleotide containing a target sequence can be used. Cas9 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas9 polypeptide (e.g., Cas9 from *S. pyogenes*). Cas9 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas9 polypeptide (e.g., from *S. pyogenes*). Cas9 can refer to the wild-type or a modified form of the Cas9 protein that can comprise an amino acid change such as a deletion, insertion, substitution, variant, mutation, fusion, chimera, or any combination thereof.

In some embodiments, a CRISPR protein-derived domain of a base editor can include all or a portion of Cas9 from *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquis* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); *Neisseria meningitidis* (NCBI Ref: YP_002342100.1), *Streptococcus pyogenes*, or *Staphylococcus aureus*.

Cas9 Domains of Nucleobase Editors

Cas9 nuclease sequences and structures are well known to those of skill in the art (See, e.g., "Complete genome sequence of an M1 strain of *Streptococcus pyogenes*." Ferretti et al., J. J., McShan W. M., Ajdic D. J., Savic D. J., Savic G., Lyon K., Primeaux C, Sezate S., Suvorov A N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663 (2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607 (2011); and "A programmable dual-RNA-guided DNA endonuclease in adaptive bacterial immunity." Jinek M., Chylinski K., Fonfara I., Hauer M., Doudna J. A., Charpentier E. Science 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference.

In some embodiments, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain (dCas9), or a Cas9 nickase (nCas9). In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild-type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild-type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild-type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild-type Cas9. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only one or more fragments thereof. Exemplary amino acid sequences of suitable Cas9 domains and Cas9 fragments are provided herein, and additional suitable sequences of Cas9 domains and fragments will be apparent to those of skill in the art.

A Cas9 protein can associate with a guide RNA that guides the Cas9 protein to a specific DNA sequence that has complementary to the guide RNA. In some embodiments, the polynucleotide programmable nucleotide binding domain is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, Cas12b/C2C1, and Cas12c/C2C3.

In some embodiments, wild-type Cas9 corresponds to Cas9 from *Streptococcus pyogenes* (NCBI Reference Sequence: NC_017053.1, nucleotide and amino acid sequences as follows):

(SEQ ID NO: 29)
```
ATGGATAAGAAATACTCAATAGGCTTAGATATCGGCACAAATAGCGTCGGATGGGCGGTGATCACTGATG

ATTATAAGGTTCCGTCTAAAAAGTTCAAGGTTCTGGGAAATACAGACCGCCACAGTATCAAAAAAATCT

TATAGGGGCTCTTTTATTTGGCAGTGGAGAGACAGCGGAAGCGACTCGTCTCAAACGGACAGCTCGTAGA

AGGTATACACGTCGGAAGAATCGTATTTGTTATCTACAGGAGATTTTTTCAAATGAGATGGCGAAAGTAG

ATGATAGTTTCTTTCATCGACTTGAAGAGTCTTTTTTGGTGGAAGAAGACAAGAAGCATGAACGTCATCC

TATTTTTGGAAATATAGTAGATGAAGTTGCTTATCATGAGAAATATCCAACTATCTATCATCTGCGAAAA

AAATTGGCAGATTCTACTGATAAAGCGGATTTGCGCTTAATCTATTTGGCCTTAGCGCATATGATTAAGT

TTCGTGGTCATTTTTTGATTGAGGGAGATTTAAATCCTGATAATAGTGATGTGGACAAACTATTTATCCA

GTTGGTACAAATCTACAATCAATTATTTGAAGAAAACCCTATTAACGCAAGTAGAGTAGATGCTAAAGCG

ATTCTTTCTGCACGATTGAGTAAATCAAGACGATTAGAAAATCTCATTGCTCAGCTCCCCGGTGAGAAGA

GAAATGGCTTGTTTGGGAATCTCATTGCTTTGTCATTGGGATTGACCCCTAATTTTAAATCAAATTTTGA
```

-continued

```
TTTGGCAGAAGATGCTAAATTACAGCTTTCAAAAGATACTTACGATGATGATTTAGATAATTTATTGGCG
CAAATTGGAGATCAATATGCTGATTTGTTTTTGGCAGCTAAGAATTTATCAGATGCTATTTTACTTTCAG
ATATCCTAAGAGTAAATAGTGAAATAACTAAGGCTCCCCTATCAGCTTCAATGATTAAGCGCTACGATGA
ACATCATCAAGACTTGACTCTTTTAAAAGCTTTAGTTCGACAACAACTTCCAGAAAAGTATAAAGAAATC
TTTTTTGATCAATCAAAAAACGGATATGCAGGTTATATTGATGGGGGAGCTAGCCAAGAAGAATTTTATA
AATTTATCAAACCAATTTTAGAAAAAATGGATGGTACTGAGGAATTATTGGTGAAACTAAATCGTGAAGA
TTTGCTGCGCAAGCAACGGACCTTTGACAACGGCTCTATTCCCCATCAAATTCACTTGGGTGAGCTGCAT
GCTATTTTGAGAAGACAAGAAGACTTTTATCCATTTTTAAAAGACAATCGTGAGAAGATTGAAAAAATCT
TGACTTTTCGAATTCCTTATTATGTTGGTCCATTGGCGCGTGGCAATAGTCGTTTTGCATGGATGACTCG
GAAGTCTGAAGAAACAATTACCCCATGGAATTTTGAAGAAGTTGTCGATAAAGGTGCTTCAGCTCAATCA
TTTATTGAACGCATGACAAACTTTGATAAAAATCTTCCAAATGAAAAGTACTACCAAACATAGTTTGC
TTTATGAGTATTTTACGGTTTATAACGAATTGACAAAGGTCAAATATGTTACTGAGGGAATGCGAAAACC
AGCATTTCTTTCAGGTGAACAGAAGAAAGCCATTGTTGATTTACTCTTCAAAACAAATCGAAAAGTAACC
GTTAAGCAATTAAAAGAAGATTATTTCAAAAAAATAGAATGTTTTGATAGTGTTGAAATTTCAGGAGTTG
AAGATAGATTTAATGCTTCATTAGGCGCCTACCATGATTTGCTAAAAATTATTAAAGATAAAGATTTTTT
GGATAATGAAGAAAATGAAGATATCTTAGAGGATATTGTTTTAACATTGACCTTATTTGAAGATAGGGGG
ATGATTGAGGAAAGACTTAAAACATATGCTCACCTCTTTGATGATAAGGTGATGAAACAGCTTAAACGTC
GCCGTTATACTGGTTGGGGACGTTTGTCTCGAAAATTGATTAATGGTATTAGGGATAAGCAATCTGGCAA
AACAATATTAGATTTTTTGAAATCAGATGGTTTTGCCAATCGCAATTTTATGCAGCTGATCCATGATGAT
AGTTTGACATTTAAAGAAGATATTCAAAAAGCACAGGTGTCTGGACAAGGCCATAGTTTACATGAACAGA
TTGCTAACTTAGCTGGCAGTCCTGCTATTAAAAAAGGTATTTTACAGACTGTAAAAATTGTTGATGAACT
GGTCAAAGTAATGGGGCATAAGCCAGAAAATATCGTTATTGAAATGGCACGTGAAAATCAGACAACTCAA
AAGGGCCAGAAAAATTCGCGAGAGCGTATGAAACGAATCGAAGAAGGTATCAAAGAATTAGGAAGTCAGA
TTCTTAAAGAGCATCCTGTTGAAAATACTCAATTGCAAAATGAAAAGCTCTATCTCTATTATCTACAAAA
TGGAAGAGACATGTATGTGGACCAAGAATTAGATATTAATCGTTTAAGTGATTATGATGTCGATCACATT
GTTCCACAAAGTTTCATTAAAGACGATTCAATAGACAATAAGGTACTAACGCGTTCTGATAAAAATCGTG
GTAAATCGGATAACGTTCCAAGTGAAGAAGTAGTCAAAAAGATGAAAAACTATTGGAGACAACTTCTAAA
CGCCAAGTTAATCACTCAACGTAAGTTTGATAATTTAACGAAAGCTGAACGTGGAGGTTTGAGTGAACTT
GATAAAGCTGGTTTTATCAAACGCCAATTGGTTGAAACTCGCCAAATCACTAAGCATGTGGCACAAATTT
TGGATAGTCGCATGAATACTAAATACGATGAAAATGATAAACTTATTCGAGAGGTTAAAGTGATTACCTT
AAAATCTAAATTAGTTTCTGACTTCCGAAAAGATTTCCAATTCTATAAAGTACGTGAGATTAACAATTAC
CATCATGCCCATGATGCGTATCTAAATGCCGTCGTTGGAACTGCTTTGATTAAGAAATATCCAAAACTTG
AATCGGAGTTTGTCTATGGTGATTATAAAGTTTATGATGTTCGTAAAATGATTGCTAAGTCTGAGCAAGA
AATAGGCAAAGCAACCGCAAAATATTTCTTTTACTCTAATATCATGAACTTCTTCAAAACAGAAATTACA
CTTGCAAATGGAGAGATTCGCAAACGCCCTCTAATCGAAACTAATGGGGAAACTGGAGAAATTGTCTGGG
ATAAAGGGCGAGATTTTGCCACAGTGCGCAAAGTATTGTCCATGCCCCAAGTCAATATTGTCAAGAAAAC
AGAAGTACGACAGGCGGATTCTCCAAGGAGTCAATTTTACCAAAAAGAAATTCGGACAAGCTTATTGCT
CGTAAAAAAGACTGGGATCCAAAAAAATATGGTGGTTTTGATAGTCCAACGGTAGCTTATTCAGTCCTAG
TGGTTGCTAAGGTGGAAAAAGGGAAATCGAAGAAGTTAAAATCCGTTAAAGAGTTACTAGGGATCACAAT
TATGGAAAGAAGTTCCTTTGAAAAAAATCCGATTGACTTTTTAGAAGCTAAAGGATATAAGGAAGTTAAA
```

```
AAAGACTTAATCATTAAACTACCTAAATATAGTCTTTTTGAGTTAGAAAACGGTCGTAAACGGATGCTGG

CTAGTGCCGGAGAATTACAAAAAGGAAATGAGCTGGCTCTGCCAAGCAAATATGTGAATTTTTTATATTT

AGCTAGTCATTATGAAAGTTGAAGGGTAGTCCAGAAGATAACGAACAAAAACAATTGTTTGTGGAGCAG

CATAAGCATTATTTAGATGAGATTATTGAGCAAATCAGTGAATTTTCTAAGCGTGTTATTTTAGCAGATG

CCAATTTAGATAAAGTTCTTAGTGCATATAACAAACATAGAGACAAACCAATACGTGAACAAGCAGAAAA

TATTATTCATTTATTTACGTTGACGAATCTTGGAGCTCCCGCTGCTTTTAAATATTTTGATACAACAATT

GATCGTAAACGATATACGTCTACAAAAGAAGTTTTAGATGCCACTCTTATCCATCAATCCATCACTGGTC

TTTATGAAACACGCATTGATTTGAGTCAGCTAGGAGGTGACTGA
```

(SEQ ID NO: 28)
```
MDKKYSIGLDIGTNSVGWAVITDDYKVPSKKFKVLGNTDRHSIKKNLIGALLFGSGETAEATRL

KRTARRRYTRRKNRICYLQEIFSNEMAKVDDSFFHRLEESFLVEEDKKHERHPIFGNIVDEVAY

HEKYPTIYHLRKKLADSTDKADLRLIYLALAHMIKFRGHFLIEGDLNPDNSDVDKLFIQLVQIY

NQLFEENPINASRVDAKAILSARLSKSRRLENLIAQLPGEKRNGLFGNLIALSLGLTPNFKSNF

DLAEDAKLQLSKDTYDDDLDNLLAQIGDQYADLFLAAKNLSDAILLSDILRVNSEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGAYHDLLKIIKDKDFLDNEENEDILEDIVLTLTLFEDRGMIEERLKTYA

HLFDDKVMKQLKRRRYTGWGRLSRKLINGIRDKQSGKTILDFLKSDGFANRNFMQLIHDDSLTF

KEDIQKAQVSGQGHSLHEQIANLAGSPAIKKGILQTVKIVDELVKVMGHKPENIVIEMAREENQT

TQKGQKNSRERMKRIEEGIKELGSQILKEHPVENTQLQNEKLYLYYLQNGRDMYVDQELDINRL

SDYDVDHIVPQSFIKDDSIDNKVLTRSDKNRGKSDNVPSEEVVKKMKNYWRQLLNAKLITQRKF

DNLTKAERGGLSELDKAGFIKRQLVETRQITKHVAQILDSRMNTKYDENDKLIREVKVITLKSK

LVSDFRKDFQFYKVREINNYHHAHDAYLNAVVGTALIKKYPKLESEFVYGDYKVYDVRKMIAKS

EQEIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVVAKVEKGK

SKKLKSVKELLGITIMERSSFEKNPIDFLEAKGYKEVKKDLIIKLPKYSLFELENGRKRMLASA

GELQKGNELALPSKYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTIDRKRYTSTKEVLDA

TLIHQSITGLYETRIDLSQLGGD
```

(single underline: HNH domain; double underline: RuvC domain)

In some embodiments, wild-type Cas9 corresponds to, or comprises, the following nucleotide and/or amino acid sequences:

(SEQ ID NO: 30)
```
ATGGATAAAAAGTATTCTATTGGTTTAGACATCGGCACTAATTCCGTTGGATGGGCTGTCATAA

CCGATGAATACAAAGTACCTTCAAAGAAATTTAAGGTGTTGGGGAACACAGACCGTCATTCGAT

TAAAAAGAATCTTATCGGTGCCCTCCTATTCGATAGTGGCGAAACGGCAGAGGCGACTCGCCTG

AAACGAACCGCTCGGAGAAGGTATACACGTCGCAAGAACCGAATATGTTACTTACAAGAAATTT

TTAGCAATGAGATGGCCAAAGTTGACGATTCTTTCTTTCACCGTTTGGAAGAGTCCTTCCTTGT
```

-continued

```
CGAAGAGGACAAGAAACATGAACGGCACCCCATCTTTGGAAACATAGTAGATGAGGTGGCATAT
CATGAAAAGTACCCAACGATTTATCACCTCAGAAAAAAGCTAGTTGACTCAACTGATAAAGCGG
ACCTGAGGTTAATCTACTTGGCTCTTGCCCATATGATAAAGTTCCGTGGGCACTTTCTCATTGA
GGGTGATCTAAATCCGGACAACTCGGATGTCGACAAACTGTTCATCCAGTTAGTACAAACCTAT
AATCAGTTGTTTGAAGAGAACCCTATAAATGCAAGTGGCGTGGATGCGAAGGCTATTCTTAGCG
CCCGCCTCTCTAAATCCCGACGGCTAGAAAACCTGATCGCACAATTACCCGGAGAGAAGAAAA
TGGGTTGTTCGGTAACCTTATAGCGCTCTCACTAGGCCTGACACCAAATTTTAAGTCGAACTTC
GACTTAGCTGAAGATGCCAAATTGCAGCTTAGTAAGGACACGTACGATGACGATCTCGACAATC
TACTGGCACAAATTGGAGATCAGTATGCGGACTTATTTTTGGCTGCCAAAAACCTTAGCGATGC
AATCCTCCTATCTGACATACTGAGAGTTAATACTGAGATTACCAAGGCGCCGTTATCCGCTTCA
ATGATCAAAAGGTACGATGAACATCACCAAGACTTGACACTTCTCAAGGCCCTAGTCCGTCAGC
AACTGCCTGAGAAATATAAGGAAATATTCTTTGATCAGTCGAAAAACGGGTACGCAGGTTATAT
TGACGGCGGAGCGAGTCAAGAGGAATTCTACAAGTTTATCAAACCCATATTAGAGAAGATGGAT
GGGACGAAGAGTTGCTTGTAAAACTCAATCGCGAAGATCTACTGCGAAAGCAGCGGACTTTCG
ACAACGGTAGCATTCCACATCAAATCCACTTAGGCGAATTGCATGCTATACTTAGAAGGCAGGA
GGATTTTTATCCGTTCCTCAAAGACAATCGTGAAAAGATTGAGAAAATCCTAACCTTTCGCATA
CCTTACTATGTGGGACCCCTGGCCCGAGGGAACTCTCGGTTCGCATGGATGACAAGAAAGTCCG
AAGAAACGATTACTCCATGGAATTTTGAGGAAGTTGTCGATAAAGGTGCGTCAGCTCAATCGTT
CATCGAGAGGATGACCAACTTTGACAAGAATTTACCGAACGAAAAAGTATTGCCTAAGCACAGT
TTACTTTACGAGTATTTCACAGTGTACAATGAACTCACGAAAGTTAAGTATGTCACTGAGGGCA
TGCGTAAACCCGCCTTTCTAAGCGGAGAACAGAAGAAAGCAATAGTAGATCTGTTATTCAAGAC
CAACCGCAAAGTGACAGTTAAGCAATTGAAAGAGGACTACTTTAAGAAAATTGAATGCTTCGAT
TCTGTCGAGATCTCCGGGGTAGAAGATCGATTTAATGCGTCACTTGGTACGTATCATGACCTCC
TAAAGATAATTAAAGATAAGGACTTCCTGGATAACGAAGAGAATGAAGATATCTTAGAAGATAT
AGTGTTGACTCTTACCCTCTTTGAAGATCGGGAAATGATTGAGGAAAGACTAAAAACATACGCT
CACCTGTTCGACGATAAGGTTATGAAACAGTTAAAGAGGCGTCGCTATACGGGCTGGGACGAT
TGTCGCGGAAACTTATCAACGGGATAAGAGACAAGCAAAGTGGTAAAACTATTCTCGATTTTCT
AAAGAGCGACGGCTTCGCCAATAGGAACTTTATGCAGCTGATCCATGATGACTCTTTAACCTTC
AAAGAGGATATACAAAAGGCACAGGTTTCCGGACAAGGGGACTCATTGCACGAACATATTGCGA
ATCTTGCTGGTTCGCCAGCCATCAAAAAGGGCATACTCCAGACAGTCAAAGTAGTGGATGAGCT
AGTTAAGGTCATGGGACGTCACAAACCGGAAAACATTGTAATCGAGATGGCACGCGAAAATCAA
ACGACTCAGAAGGGGCAAAAAAACAGTCGAGAGCGGATGAAGAGAATAGAAGAGGGTATTAAAG
AACTGGCAGCCAGATCTTAAAGGAGCATCCTGTGGAAAATACCCAATTGCAGAACGAGAAACT
TTACCTCTATTACCTACAAAATGGAAGGGACATGTATGTTGATCAGGAACTGGACATAAACCGT
TTATCTGATTACGACGTCGATCACATTGTACCCCAATCCTTTTTGAAGGACGATTCAATCGACA
ATAAAGTGCTTACACGCTCGGATAAGAACCGAGGGAAAAGTGACAATGTTCCAAGCGAGGAAGT
CGTAAAGAAAATGAAGAACTATTGGCGGCAGCTCCTAAATGCGAAACTGATAACGCAAAGAAAG
TTCGATAACTTAACTAAAGCTGAGAGGGGTGGCTTGTCTGAACTTGACAAGGCCGGATTTATTA
AACGTCAGCTCGTGGAAACCCGCCAAATCACAAAGCATGTTGCACAGATACTAGATTCCCGAAT
GAATACGAAATACGACGAGAACGATAAGCTGATTCGGGAAGTCAAAGTAATCACTTTAAAGTCA
AAATTGGTGTCGGACTTCAGAAAGGATTTTCAATTCTATAAAGTTAGGGAGATAAATAACTACC
```

-continued

```
ACCATGCGCACGACGCTTATCTTAATGCCGTCGTAGGGACCGCACTCATTAAGAAATACCCGAA

GCTAGAAAGTGAGTTTGTGTATGGTGATTACAAAGTTTATGACGTCCGTAAGATGATCGCGAAA

AGCGAACAGGAGATAGGCAAGGCTACAGCCAAATACTTCTTTTATTCTAACATTATGAATTTCT

TTAAGACGGAAATCACTCTGGCAAACGGAGAGATACGCAAACGACCTTTAATTGAAACCAATGG

GGAGACAGGTGAAATCGTATGGGATAAGGGCCGGGACTTCGCGACGGTGAGAAAAGTTTTGTCC

ATGCCCCAAGTCAACATAGTAAAGAAAACTGAGGTGCAGACCGGAGGGTTTTCAAAGGAATCGA

TTCTTCCAAAAAGGAATAGTGATAAGCTCATCGCTCGTAAAAAGGACTGGGACCCGAAAAAGTA

CGGTGGCTTCGATAGCCCTACAGTTGCCTATTCTGTCCTAGTAGTGGCAAAAGTTGAGAAGGGA

AAATCCAAGAAACTGAAGTCAGTCAAAGAATTATTGGGGATAACGATTATGGAGCGCTCGTCTT

TTGAAAAGAACCCCATCGACTTCCTTGAGGCGAAAGGTTACAAGGAAGTAAAAAAGGATCTCAT

AATTAAACTACCAAAGTATAGTCTGTTTGAGTTAGAAAATGGCCGAAAACGGATGTTGGCTAGC

GCCGGAGAGCTTCAAAAGGGGAACGAACTCGCACTACCGTCTAAATACGTGAATTTCCTGTATT

TAGCGTCCCATTACGAGAAGTTGAAAGGTTCACCTGAAGATAACGAACAGAAGCAACTTTTTGT

TGAGCAGCACAAACATTATCTCGACGAAATCATAGAGCAAATTTCGGAATTCAGTAAGAGAGTC

ATCCTAGCTGATGCCAATCTGGACAAAGTATTAAGCGCATACAACAAGCACAGGGATAAACCCA

TACGTGAGCAGGCGGAAAATATTATCCATTTGTTTACTCTTACCAACCTCGGCGCTCCAGCCGC

ATTCAAGTATTTTGACACAACGATAGATCGCAAACGATACACTTCTACCAAGGAGGTGCTAGAC

GCGACACTGATTCACCAATCCATCACGGGATTATATGAAACTCGGATAGATTTGTCACAGCTTG

GGGGTGACGGATCCCCCAAGAAGAAGAGGAAAGTCTCGAGCGACTACAAAGACCATGACGGTGA

TTATAAAGATCATGACATCGATTACAAGGATGACGATGACAAGGCTGCAGGA
```

(SEQ ID NO: 31)

MDKK<u>YSIGLAIGTNSVGWAVITDEYKVPSKKFKVLGNTDRHSIKKNLIGALLFDSGETA</u>EATRL

KRTARRRYTRRKNRICYLQEIFSNEMAKVDDSFFHRLEESFLVEEDKKHERHPIFGNIVDEAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQG<u>DSLHEHIANLAGSPAIKKGILQTVKVVDELVKVMGRHKPENIVIEMA</u>RENQ

TTQKG<u>QKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERG</u><u>GLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKES</u>ILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

-continued

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain)

In some embodiments, wild-type Cas9 corresponds to Cas9 from *Streptococcus pyogenes* (NCBI Reference Sequence: NC_002737.2 (nucleotide sequence as follows); and Uniprot Reference Sequence: Q99ZW2 (amino acid sequence as follows):

(SEQ ID NO: 32)
ATGGATAAGAAATACTCAATAGGCTTAGATATCGGCACAAATAGCGTCGGATGGGCGGTGATCA

CTGATGAATATAAGGTTCCGTCTAAAAAGTTCAAGGTTCTGGGAAATACAGACCGCCACAGTAT

CAAAAAAATCTTATAGGGGCTCTTTTATTTGACAGTGGAGAGACAGCGGAAGCGACTCGTCTC

AAACGGACAGCTCGTAGAAGGTATACACGTCGGAAGAATCGTATTTGTTATCTACAGGAGATTT

TTTCAAATGAGATGGCGAAAGTAGATGATAGTTTCTTTCATCGACTTGAAGAGTCTTTTTTGGT

GGAAGAAGACAAGAAGCATGAACGTCATCCTATTTTTGGAAATATAGTAGATGAAGTTGCTTAT

CATGAGAAATATCCAACTATCTATCATCTGCGAAAAAATTGGTAGATTCTACTGATAAAGCGG

ATTTGCGCTTAATCTATTTGGCCTTAGCGCATATGATTAAGTTTCGTGGTCATTTTTTGATTGA

GGGAGATTTAAATCCTGATAATAGTGATGTGGACAAACTATTTATCCAGTTGGTACAAACCTAC

AATCAATTATTTGAAGAAAACCCTATTAACGCAAGTGGAGTAGATGCTAAAGCGATTCTTTCTG

CACGATTGAGTAAATCAAGACGATTAGAAAATCTCATTGCTCAGCTCCCCGGTGAGAAGAAAA

TGGCTTATTTGGGAATCTCATTGCTTTGTCATTGGGTTTGACCCCTAATTTTAAATCAAATTTT

GATTTGGCAGAAGATGCTAAATTACAGCTTTCAAAAGATACTTACGATGATGATTTAGATAATT

TATTGGCGCAAATTGGAGATCAATATGCTGATTTGTTTTTGGCAGCTAAGAATTTATCAGATGC

TATTTTACTTTCAGATATCCTAAGAGTAAATACTGAAATAACTAAGGCTCCCCTATCAGCTTCA

ATGATTAAACGCTACGATGAACATCATCAAGACTTGACTCTTTTAAAAGCTTTAGTTCGACAAC

AACTTCCAGAAAAGTATAAAGAAATCTTTTTTGATCAATCAAAAAACGGATATGCAGGTTATAT

TGATGGGGGAGCTAGCCAAGAAGAATTTTATAAATTTATCAAACCAATTTTAGAAAAAATGGAT

GGTACTGAGGAATTATTGGTGAAACTAAATCGTGAAGATTGCTGCGCAAGCAACGGACCTTTG

ACAACGGCTCTATTCCCCATCAAATTCACTTGGGTGAGCTGCATGCTATTTTGAAGAAGACAAGA

AGACTTTTATCCATTTTTAAAAGACAATCGTGAGAAGATTGAAAAAATCTTGACTTTTCGAATT

CCTTATTATGTTGGTCCATTGGCGCGTGGCAATAGTCGTTTTGCATGGATGACTCGGAAGTCTG

AAGAAACAATTACCCCATGGAATTTTGAAGAAGTTGTCGATAAAGGTGCTTCAGCTCAATCATT

TATTGAACGCATGACAAACTTTGATAAAAATCTTCCAAATGAAAAGTACTACCAAAACATAGT

TTGCTTTATGAGTATTTTACGGTTTATAACGAATTGACAAAGGTCAAATATGTTACTGAAGGAA

TGCGAAAACCAGCATTTCTTTCAGGTGAACAGAAGAAAGCCATTGTTGATTTACTCTTCAAAAC

AAATCGAAAAGTAACCGTTAAGCAATTAAAAGAAGATTATTTCAAAAAAATAGAATGTTTTGAT

AGTGTTGAAATTTCAGGAGTTGAAGATAGATTTAATGCTTCATTAGGTACCTACCATGATTTGC

TAAAAATTATTAAAGATAAAGATTTTTTGGATAATGAAGAAAATGAAGATATCTTAGAGGATAT

TGTTTTAACATTGACCTTATTTGAAGATAGGGAGATGATTGAGGAAAGACTTAAAACATATGCT

CACCTCTTTGATGATAAGGTGATGAAACAGCTTAAACGTCGCCGTTATACTGGTTGGGGACGTT

TGTCTCGAAAATTGATTAATGGTATTAGGGATAAGCAATCTGGCAAAACAATATTAGATTTTT

-continued

```
GAAATCAGATGGTTTTGCCAATCGCAATTTTATGCAGCTGATCCATGATGATAGTTTGACATTT

AAAGAAGACATTCAAAAAGCACAAGTGTCTGGACAAGGCGATAGTTTACATGAACATATTGCAA

ATTTAGCTGGTAGCCCTGCTATTAAAAAAGGTATTTTACAGACTGTAAAAGTTGTTGATGAATT

GGTCAAAGTAATGGGGCGGCATAAGCCAGAAAATATCGTTATTGAAATGGCACGTGAAAATCAG

ACAACTCAAAAGGGCCAGAAAAATTCGCGAGAGCGTATGAAACGAATCGAAGAAGGTATCAAAG

AATTAGGAAGTCAGATTCTTAAAGAGCATCCTGTTGAAAATACTCAATTGCAAAATGAAAAGCT

CTATCTCTATTATCTCCAAAATGGAAGAGACATGTATGTGGACCAAGAATTAGATATTAATCGT

TTAAGTGATTATGATGTCGATCACATTGTTCCACAAAGTTTCCTTAAAGACGATTCAATAGACA

ATAAGGTCTTAACGCGTTCTGATAAAAATCGTGGTAAATCGGATAACGTTCCAAGTGAAGAAGT

AGTCAAAAGATGAAAAACTATTGGAGACAACTTCTAAACGCCAAGTTAATCACTCAACGTAAG

TTTGATAATTTAACGAAAGCTGAACGTGGAGGTTTGAGTGAACTTGATAAAGCTGGTTTTATCA

AACGCCAATTGGTTGAAACTCGCCAAATCACTAAGCATGTGGCACAAATTTTGGATAGTCGCAT

GAATACTAAATACGATGAAAATGATAAACTTATTCGAGAGGTTAAAGTGATTACCTTAAAATCT

AAATTAGTTTCTGACTTCCGAAAAGATTTCCAATTCTATAAAGTACGTGAGATTAACAATTACC

ATCATGCCCATGATGCGTATCTAAATGCCGTCGTTGGAACTGCTTTGATTAAGAAATATCCAAA

ACTTGAATCGGAGTTTGTCTATGGTGATTATAAAGTTTATGATGTTCGTAAAATGATTGCTAAG

TCTGAGCAAGAAATAGGCAAAGCAACCGCAAAATATTTCTTTTACTCTAATATCATGAACTTCT

TCAAAACAGAAATTACACTTGCAAATGGAGAGATTCGCAAACGCCCTCTAATCGAAACTAATGG

GGAAACTGGAGAAATTGTCTGGGATAAAGGGCGAGATTTTGCCACAGTGCGCAAAGTATTGTCC

ATGCCCCAAGTCAATATTGTCAAGAAAACAGAAGTACAGACAGGCGGATTCTCCAAGGAGTCAA

TTTTACCAAAAGAAATTCGGACAAGCTTATTGCTCGTAAAAAAGACTGGGATCCAAAAAAATA

TGGTGGTTTTGATAGTCCAACGGTAGCTTATTCAGTCCTAGTGGTTGCTAAGGTGGAAAAAGGG

AAATCGAAGAAGTTAAAATCCGTTAAAGAGTTACTAGGGATCACAATTATGGAAAGAAGTTCCT

TTGAAAAAATCCGATTGACTTTTTAGAAGCTAAAGGATATAAGGAAGTTAAAAAAGACTTAAT

CATTAAACTACCTAAATATAGTCTTTTTGAGTTAGAAAACGGTCGTAAACGGATGCTGGCTAGT

GCCGGAGAATTACAAAAAGGAAATGAGCTGGCTCTGCCAAGCAAATATGTGAATTTTTTATATT

TAGCTAGTCATTATGAAAAGTTGAAGGGTAGTCCAGAAGATAACGAACAAAAACAATTGTTTGT

GGAGCAGCATAAGCATTATTTAGATGAGATTATTGAGCAAATCAGTGAATTTTCTAAGCGTGTT

ATTTTAGCAGATGCCAATTTAGATAAAGTTCTTAGTGCATATAACAAACATAGAGACAAACCAA

TACGTGAACAAGCAGAAATATTATTCATTTATTTACGTTGACGAATCTTGGAGCTCCCGCTGC

TTTTAAATATTTTGATACAACAATTGATCGTAAACGATATACGTCTACAAAAGAAGTTTTAGAT

GCCACTCTTATCCATCAATCCATCACTGGTCTTTATGAAACACGCATTGATTTGAGTCAGCTAG

GAGGTGACTGA
```

(SEQ ID NO: 1)
MDKK<u>YSIGLDIGINSVGWAVITDEYKVPSKKFKVLGNIDRHSIKKNLIGALLFDSGET</u>AEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

```
-continued
PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDHIVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVYDVRKMIAK

SEQEIGKATAKYFFYSNIMNFFKTEITLANGEIRKRPLIETNGETGEIVWDKGRDFATVRKVLS

MPQVNIVKKTEVQTGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain)
```

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the Cas9 protein is a Cas9 nickase (nCas9). In some embodiments, the Cas9 protein is a nuclease active Cas9.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth herein, or a corresponding mutation in any of the amino acid sequences provided herein, wherein X is any amino acid change. In some embodiments, the nuclease-inactive dCas9 domain comprises a D10A mutation and a H840A mutation of the amino acid sequence set forth herein, or a corresponding mutation in any of the amino acid sequences provided herein. As one example, a nuclease-inactive Cas9 domain comprises the amino acid sequence set forth in Cloning vector pPlatTET-gRNA2 (Accession No. BAV54124).

The amino acid sequence of an exemplary catalytically inactive Cas9 (dCas9) is as follows:

```
                                               (SEQ ID NO: 35)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI
```

```
TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLINLGAPAAFKYFDTTIDRKRYTSTKEVLDATLIHQ

SITGLYETRIDLSQLGGD
```

(see, e.g., Qi et al., "Repurposing CRISPR as an RNA-guided platform for sequence-specific control of gene expression." *Cell.* 2013; 152(5):1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference).

In some embodiments, a Cas9 nuclease has an inactive (e.g., an inactivated) DNA cleavage domain, that is, the Cas9 is a nickase, referred to as an "nCas9" protein (for "nickase" Cas9). A nuclease-inactivated Cas9 protein may interchangeably be referred to as a "dCas9" protein (for nuclease-"dead" Cas9) or catalytically inactive Cas9. Methods for generating a Cas9 protein (or a fragment thereof) having an inactive DNA cleavage domain are known (See, e.g., Jinek et al., *Science.* 337:816-821 (2012); Qi et al., "Repurposing CRISPR as an RNA-Guided Platform for Sequence-Specific Control of Gene Expression" (2013) *Cell.* 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., Science. 337:816-821 (2012); Qi et al., *Cell.* 28; 152(5):1173-83 (2013)).

In some embodiments, the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation or corresponding mutations in another Cas9.

In some embodiments, the dCas9 comprises the amino acid sequence of dCas9 (D10A and H840A):

```
                                            (SEQ ID NO: 35)
MDKKYSIGLAIGINSVGWAVITDEYKVPSKKFKVLGNTDRHSIKKNLIGALLFDSGETAEATRL

KRTARRRYTRRKNRICYLQEIFSNEMAKVDDSFFHRLEESFLVEEDKKHERHPIFGNIVDEVAY

HEKYPTIYHLRKKLVDSTDKADLRLIYLALAHMIKFRGHFLIEGDLNPDNSDVDKLFIQLVQTY

NQLFEENPINASGVDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILRVNTEITKAPLSAS

MIKRYDEHHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKILTFRI

PYYVGPLARGNSRFAWMTRKSEETITPWNFEEVVDKGASAQSFIERMTNFDKNLPNEKVLPKHS

LLYEYFTVYNELTKVKYVTEGMRKPAFLSGEQKKAIVDLLFKTNRKVTVKQLKEDYFKKIECFD

SVEISGVEDRFNASLGTYHDLLKIIKDKDFLDNEENEDILEDIVLTLTLFEDREMIEERLKTYA

HLFDDKVMKQLKRRRYTGWGRLSRKLINGIRDKQSGKTILDFLKSDGFANRNFMQLIHDDSLTF

KEDIQKAQVSGQGDSLHEHIANLAGSPAIKKGILQTVKVVDELVKVMGRHKPENIVIEMARENQ

TTQKGQKNSRERMKRIEEGIKELGSQILKEHPVENTQLQNEKLYLYYLQNGRDMYVDQELDINR

LSDYDVDAIVPQSFLKDDSIDNKVLTRSDKNRGKSDNVPSEEVVKKMKNYWRQLLNAKLITQRK
```

-continued

<u>FDNLTKAERG</u><u><u>GLSELDKAGFIKRQLVETRQITKHVAQILDSRMNTKYDENDKLIREVKVITLKS</u></u>

<u><u>KLVSDFRKDFQFYKVREINNYHHAHDAYLNAVVGTALIKKYPKLESEFVYGDYKVYDVRKMIAK</u></u>

<u><u>SEQEIGKATAKYFFYSNIMNFFKTEITLANGEIRKRPLIETNGETGEIVWDKGRDFATVRKVLS</u></u>

<u><u>MPQVNIVKKTEVQ</u></u>TGGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYSLFELENGRKRMLAS

AGELQKGNELALPSKYVNFLYLASHYEKLKGSPEDNEQKQLFVEQHKHYLDEIIEQISEFSKRV

ILADANLDKVLSAYNKHRDKPIREQAENIIHLFTLTNLGAPAAFKYFDTTIDRKRYTSTKEVLD

ATLIHQSITGLYETRIDLSQLGGD (single underline: HNH domain; double underline: RuvC domain).

In some embodiments, the Cas9 domain comprises a D10A mutation, while the residue at position 840 remains a histidine in the amino acid sequence provided above, or at corresponding positions in any of the amino acid sequences provided herein.

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 are provided which are at least about 70% identical, at least about 80% identical, at least about 90% identical, at least about 95% identical, at least about 98% identical, at least about 99% identical, at least about 99.5% identical, or at least about 99.9% identical. In some embodiments, variants of dCas9 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. In some embodiments the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10, or a corresponding mutation. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field and are within the scope of this disclosure.

The amino acid sequence of an exemplary catalytically Cas9 nickase (nCas9) is as follows:

(SEQ ID NO: 31)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD

In some embodiments, Cas9 refers to a Cas9 from archaea (e.g., nanoarchaea), which constitute a domain and kingdom of single-celled prokaryotic microbes. In some embodiments, the programmable nucleotide binding protein may be a CasX or CasY protein, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, in a base editor system described herein Cas9 is replaced by CasX, or a variant of CasX. In some embodiments, in a base editor system described herein Cas9 is replaced by CasY, or a variant of CasY. It should be appreciated that other RNA-guided DNA binding proteins may be used as a nucleic acid programmable DNA binding protein (napDNAbp) and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the programmable nucleotide binding protein is a naturally-occurring CasX or CasY protein. In some embodiments, the programmable nucleotide binding protein comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any CasX or CasY protein described herein. It should be appreciated that CasX and CasY from other bacterial species may also be used in accordance with the present disclosure.

An exemplary CasX ((uniprot.org/uniprot/F0NN87; uniprot.org/uniprot/F0NH53) tr|F0NN87|F0NN87_SULIHCRISPR-associatedCasx protein OS=*Sulfolobus islandicus* (strain HVE10/4) GN=SiH_0402 PE=4 SV=1) amino acid sequence is as follows:

(SEQ ID NO: 40)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYEFGRSPGMVERTRRVKLE

VEPHYLIIAAAGWVLTRLGKAKVSEGDYVGVNVFTPTRGILYSLIQNVNG

IVPGIKPETAFGLWIARKVVSSVTNPNVSVVRIYTISDAVGQNPTTINGG

FSIDLTKLLEKRYLLSERLEAIARNALSISSNMRERYIVLANYIYEYLTG

SKRLEDLLYFANRDLIMNLNSDDGKVRDLKLISAYVNGELIRGEG.

An exemplary CasX (>tr|F0NH53|F0NH53_SULIR CRISPR associated protein, Casx OS=*Sulfolobus islandicus* (strain REY15A) GN=SiRe_0771 PE=4 SV=1) amino acid sequence is as follows:

(SEQ ID NO: 41)
MEVPLYNIFGDNYIIQVATEAENSTIYNNKVEIDDEELRNVLNLAYKIAK

NNEDAAAERRGKAKKKKGEEGETTTSNIILPLSGNDKNPWTETLKCYNFP

TTVALSEVFKNFSQVKECEEVSAPSFVKPEFYKFGRSPGMVERTRRVKLE

VEPHYLIMAAAGWVLTRLGKAKVSEGDYVGVNVFTPTRGILYSLIQNVNG

IVPGIKPETAFGLWIARKVVSSVTNPNVSVVSIYTISDAVGQNPTTINGG

FSIDLTKLLEKRDLLSERLEAIARNALSISSNMRERYIVLANYIYEYLIG

SKRLEDLLYFANRDLIMNLNSDDGKVRDLKLISAYVNGELIRGEG.

Deltaproteobacteria CasX
(SEQ ID NO: 79)
MEKRINKIRKKLSADNATKPVSRSGPMKTLLVRVMTDDLKKRLEKRRKKP

EVMPQVISNNAANNLRMLLDDYTKMKEAILQVYWQEFKDDHVGLMCKFAQ

PASKKIDQNKLKPEMDEKGNLTTAGFACSQCGQPLFVYKLEQVSEKGKAY

TNYFGRCNVAEHEKLILLAQLKPVKDSDEAVTYSLGKFGQRALDFYSIHV

TKESTHPVKPLAQIAGNRYASGPVGKALSDACMGTIASFLSKYQDIIIEH

QKVVKGNQKRLESLRELAGKENLEYPSVTLPPQPHTKEGVDfAYNEVIAR

VRMWVNLNLWQKLKLSRDDAKPLLRLKGFPSFPVVERRENEVDWWNTINE

VKKLIDAKRDMGRVFWSGVTAEKRNTILEGYNYLPNENDHKKREGSLENP

KKPAKRQFGDLLLYLEKKYAGDWGKVFDEAWERIDKKIAGLTSHIEREEA

RNAEDAQSKAVLTDWLRAKASFVLERLKEMDEKEFYACEIQLQKWYGDLR

GNPFAVEAENRVVDISGFSIGSDGHSIQYRNLLAWKYLENGKREFYLLMN

YGKKGRIRFTDGTDIKKSGKWQGLLYGGGKAKVIDLTFDPDDEQLIILPL

AFGTRQGREFIWNDLLSLETGLIKLANGRVIEKTIYNKKIGRDEPALFVA

LTFERREVVDPSNIKPVNLIGVARGENIPAVIALTDPEGCPLPEFKDSSG

GPTDILRIGEGYKEKQRAIQAAKEVEQRRAGGYSRKFASKSRNLADDMVR

NSARDLFYHAVTHDAVLVFANLSRGFGRQGKRTFMTERQYTKMEDWLTAK

LAYEGLTSKTYLSKTLAQYTSKTCSNCGFTITYADMDVMLVRLKKTSDGW

ATTLNNKELKAEYQITYYNRYKRQTVEKELSAELDRLSEESGNNDISKWT

KGRRDEALFLLKKRFSHRPVQEQFVCLDCGHEVHAAEQAALNIARSWLFL

NSNSTEFKSYKSGKQPFVGAWQAFYKRRLKEVWKPNA

An exemplary CasY ((ncbi.nlm.nih.gov/protein/APG80656.1)>APG80656.1 CRISPR-associated protein CasY [uncultured Parcubacteria group bacterium]) amino acid sequence is as follows:

(SEQ ID NO: 43)
MSKRHPRISGVKGYRLHAQRLEYTGKSGAMRTIKYPLYSSPSGGRTVPRE

IVSAINDDYVGLYGLSNFDDLYNAEKRNEEKVYSVLDFWYDCVQYGAVFS

YTAPGLLKNVAEVRGGSYELTKTLKGSHLYDELQIDKVIKFLNKKEISRA

NGSLDKLKKDIIDCFKAEYRERHKDQCNKLADDIKNAKKDAGASLGERQK

KLFRDFFGISEQSENDKPSFTNPLNLTCCLLPFDTVNNNRNRGEVLFNKL

KEYAQKLDKNEGSLEMWEYIGIGNSGTAFSNFLGEGFLGRLRENKITELK

KAMMDITDAWRGQEQEEELEKRLRILAALTIKLREPKFDNHWGGYRSDIN

GKLSSWLQNYINQTVKIKEDLKGHKKDLKKAKEMINRFGESDTKEEAVVS

```
-continued
SLLESIEKIVPDDSADDEKPDIPAIAIYRRFLSDGRLTLNRFVQREDVQE

ALIKERLEAEKKKKPKKRKKKSDAEDEKETIDFKELFPHLAKPLKLVPNF

YGDSKRELYKKYKNAAIYTDALWKAVEKIYKSAFSSSLKNSFFDTDFDKD

FFIKRLQKIFSVYRRFNTDKWKPIVKNSFAPYCDIVSLAENEVLYKPKQS

RSRKSAAIDKNRVRLPSTENIAKAGIALARELSVAGFDWKDLLKKEEHEE

YIDLIELHKTALALLLAVTETQLDISALDFVENGTVKDFMKTRDGNLVLE

GRFLEMFSQSIVFSELRGLAGLMSRKEFITRSAIQTMNGKQAELLYIPHE

FQSAKITTPKEMSRAFLDLAPAEFATSLEPESLSEKSLLKLKQMRYYPHY

FGYELTRTGQGIDGGVAENALRLEKSPVKKREIKCKQYKTLGRGQNKIVL

YVRSSYYQTQFLEWFLHRPKNVQTDVAVSGSFLIDEKKVKTRWNYDALTV

ALEPVSGSERVFVSQPFTIFPEKSAEEEGQRYLGIDIGEYGIAYTALEIT

GDSAKILDQNFISDPQLKTLREEVKGLKLDQRRGTFAMPSTKIARIRESL

VHSLRNRIHHLALKHKAKIVYELEVSRFEEGKQKIKKVYATLKKADVYSE

IDADKNLQTTVWGKLAVASEISASYTSQFCGACKKLWRAEMQVDETITTQ

ELIGTVRVIKGGTLIDAIKDFMRPPIFDENDTPFPKYRDFCDKHHISKKM

RGNSCLFICPFCRANADADIQASQTIALLRYVKEEKKVEDYFERFRKLKN

IKVLGQMKKI.
```

The Cas9 nuclease has two functional endonuclease domains: RuvC and HNH. Cas9 undergoes a conformational change upon target binding that positions the nuclease domains to cleave opposite strands of the target DNA. The end result of Cas9-mediated DNA cleavage is a double-strand break (DSB) within the target DNA (~3-4 nucleotides upstream of the PAM sequence). The resulting DSB is then repaired by one of two general repair pathways: (1) the efficient but error-prone non-homologous end joining (NHEJ) pathway; or (2) the less efficient but high-fidelity homology directed repair (HDR) pathway.

The "efficiency" of non-homologous end joining (NHEJ) and/or homology directed repair (HDR) can be calculated by any convenient method. For example, in some embodiments, efficiency can be expressed in terms of percentage of successful HDR. For example, a surveyor nuclease assay can be used to generate cleavage products and the ratio of products to substrate can be used to calculate the percentage. For example, a surveyor nuclease enzyme can be used that directly cleaves DNA containing a newly integrated restriction sequence as the result of successful HDR. More cleaved substrate indicates a greater percent HDR (a greater efficiency of HDR). As an illustrative example, a fraction (percentage) of HDR can be calculated using the following equation [(cleavage products)/(substrate plus cleavage products)] (e.g., $(b+c)/(a+b+c)$, where "a" is the band intensity of DNA substrate and "b" and "c" are the cleavage products).

In some embodiments, efficiency can be expressed in terms of percentage of successful NHEJ. For example, a T7 endonuclease I assay can be used to generate cleavage products and the ratio of products to substrate can be used to calculate the percentage NHEJ. T7 endonuclease I cleaves mismatched heteroduplex DNA which arises from hybridization of wild-type and mutant DNA strands (NHEJ generates small random insertions or deletions (indels) at the site of the original break). More cleavage indicates a greater percent NHEJ (a greater efficiency of NHEJ). As an illustrative example, a fraction (percentage) of NHEJ can be calculated using the following equation: $(1-(1-(b+c)/(a+b+c))^{1/2})\times 100$, where "a" is the band intensity of DNA substrate and "b" and "c" are the cleavage products (Ran et. al., Cell. 2013 Sep. 12; 154(6):1380-9; and Ran et al., Nat Protoc. 2013 November; 8(11): 2281-2308).

The NHEJ repair pathway is the most active repair mechanism, and it frequently causes small nucleotide insertions or deletions (indels) at the DSB site. The randomness of NHEJ-mediated DSB repair has important practical implications, because a population of cells expressing Cas9 and a gRNA or a guide polynucleotide can result in a diverse array of mutations. In most cases, NHEJ gives rise to small indels in the target DNA that result in amino acid deletions, insertions, or frameshift mutations leading to premature stop codons within the open reading frame (ORF) of the targeted gene. The ideal end result is a loss-of-function mutation within the targeted gene.

While NHEJ-mediated DSB repair often disrupts the open reading frame of the gene, homology directed repair (HDR) can be used to generate specific nucleotide changes ranging from a single nucleotide change to large insertions like the addition of a fluorophore or tag. In order to utilize HDR for gene editing, a DNA repair template containing the desired sequence can be delivered into the cell type of interest with the gRNA(s) and Cas9 or Cas9 nickase. The repair template can contain the desired edit as well as additional homologous sequence immediately upstream and downstream of the target (termed left & right homology arms). The length of each homology arm can be dependent on the size of the change being introduced, with larger insertions requiring longer homology arms. The repair template can be a single-stranded oligonucleotide, double-stranded oligonucleotide, or a double-stranded DNA plasmid. The efficiency of HDR is generally low (<10% of modified alleles) even in cells that express Cas9, gRNA and an exogenous repair template. The efficiency of HDR can be enhanced by synchronizing the cells, since HDR takes place during the S and G2 phases of the cell cycle. Chemically or genetically inhibiting genes involved in NHEJ can also increase HDR frequency.

In some embodiments, Cas9 is a modified Cas9. A given gRNA targeting sequence can have additional sites throughout the genome where partial homology exists. These sites are called off-targets and need to be considered when designing a gRNA. In addition to optimizing gRNA design, CRISPR specificity can also be increased through modifications to Cas9. Cas9 generates double-strand breaks (DSBs) through the combined activity of two nuclease domains, RuvC and HNH. Cas9 nickase, a D10A mutant of SpCas9, retains one nuclease domain and generates a DNA nick rather than a DSB. The nickase system can also be combined with HDR-mediated gene editing for specific gene edits.

In some embodiments, Cas9 is a variant Cas9 protein. A variant Cas9 polypeptide has an amino acid sequence that is different by one amino acid (e.g., has a deletion, insertion, substitution, fusion) when compared to the amino acid sequence of a wild type Cas9 protein. In some instances, the variant Cas9 polypeptide has an amino acid change (e.g., deletion, insertion, or substitution) that reduces the nuclease activity of the Cas9 polypeptide. For example, in some instances, the variant Cas9 polypeptide has less than 50%, less than 40%, less than 30%, less than 20%, less than 10%, less than 5%, or less than 1% of the nuclease activity of the corresponding wild-type Cas9 protein. In some embodiments, the variant Cas9 protein has no substantial nuclease activity. When a subject Cas9 protein is a variant Cas9 protein that has no substantial nuclease activity, it can be referred to as "dCas9."

In some embodiments, a variant Cas9 protein has reduced nuclease activity. For example, a variant Cas9 protein exhibits less than about 20%, less than about 15%, less than about 10%, less than about 5%, less than about 1%, or less than about 0.1%, of the endonuclease activity of a wild-type Cas9 protein, e.g., a wild-type Cas9 protein.

In some embodiments, a variant Cas9 protein can cleave the complementary strand of a guide target sequence but has reduced ability to cleave the non-complementary strand of a double stranded guide target sequence. For example, the variant Cas9 protein can have a mutation (amino acid substitution) that reduces the function of the RuvC domain. As a non-limiting example, in some embodiments, a variant Cas9 protein has a D10A (aspartate to alanine at amino acid position 10) and can therefore cleave the complementary strand of a double stranded guide target sequence but has reduced ability to cleave the non-complementary strand of a double stranded guide target sequence (thus resulting in a single strand break (SSB) instead of a double strand break (DSB) when the variant Cas9 protein cleaves a double stranded target nucleic acid) (see, for example, Jinek et al., Science. 2012 Aug. 17; 337(6096):816-21).

In some embodiments, a variant Cas9 protein can cleave the non-complementary strand of a double stranded guide target sequence but has reduced ability to cleave the complementary strand of the guide target sequence. For example, the variant Cas9 protein can have a mutation (amino acid substitution) that reduces the function of the HNH domain (RuvC/HNH/RuvC domain motifs). As a non-limiting example, in some embodiments, the variant Cas9 protein has an H840A (histidine to alanine at amino acid position 840) mutation and can therefore cleave the non-complementary strand of the guide target sequence but has reduced ability to cleave the complementary strand of the guide target sequence (thus resulting in a SSB instead of a DSB when the variant Cas9 protein cleaves a double stranded guide target sequence). Such a Cas9 protein has a reduced ability to cleave a guide target sequence (e.g., a single stranded guide target sequence) but retains the ability to bind a guide target sequence (e.g., a single stranded guide target sequence).

In some embodiments, a variant Cas9 protein has a reduced ability to cleave both the complementary and the non-complementary strands of a double stranded target DNA. As a non-limiting example, in some embodiments, the variant Cas9 protein harbors both the D10A and the H840A mutations such that the polypeptide has a reduced ability to cleave both the complementary and the non-complementary strands of a double stranded target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors W476A and W1126A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA).

As another non-limiting example, in some embodiments, the variant Cas9 protein harbors H840A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors H840A, D10A, W476A, and W1126A, mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, the variant Cas9 has restored catalytic His residue at position 840 in the Cas9 HNH domain (A840H).

As another non-limiting example, in some embodiments, the variant Cas9 protein harbors, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1127A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1127A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a variant Cas9 protein that has reduced catalytic activity (e.g., when a Cas9 protein has a D10, G12, G17, E762, H840, N854, N863, H982, H983, A984, D986, and/or a A987 mutation, e.g., D10A, G12A, G17A, E762A, H840A, N854A, N863A, H982A, H983A, A984A, and/or D986A), the variant Cas9 protein can still bind to target DNA in a site-specific manner (because it is still guided to a target DNA sequence by a guide RNA) as long as it retains the ability to interact with the guide RNA.

In some embodiments, the variant Cas protein can be spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, a modified SpCas9 including amino acid substitutions D1135M, S1136Q, G1218K, E1219F, A1322R, D1332A, R1335E, and T1337R (SpCas9-MQKFRAER) and having specificity for the altered PAM 5'-NGC-3' was used.

Alternatives to *S. pyogenes* Cas9 can include RNA-guided endonucleases from the Cpf1 family that display cleavage activity in mammalian cells. CRISPR from *Prevotella* and *Francisella* 1 (CRISPR/Cpf1) is a DNA-editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1 does not have an HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas1, Cas2 and Cas4 proteins more similar to types I and III than from type II systems. Functional Cpf1 doesn't need the trans-activating CRISPR RNA (tracrRNA), therefore, only CRISPR (crRNA) is required. This benefits genome editing because Cpf1 is not only smaller than Cas9, but also it has a smaller sgRNA molecule (proximately half as many nucleotides as Cas9). The Cpf1-crRNA complex cleaves target DNA or RNA by identification of a protospacer adjacent motif 5'-YTN-3' in contrast to the G-rich PAM targeted by Cas9. After identification of PAM, Cpf1 introduces a sticky-end-like DNA double-stranded break of 4 or 5 nucleotides overhang.

Cas12 Domains of Nucleobase Editors

Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors, albeit different types (Type II and Type V, respectively). In addition to Cpf1, Class 2, Type V CRISPR-Cas systems also comprise Cas12a/Cpf1, Cas12b/C2c1, Cas12c/C2c3, Cas12d/CasY, Cas12e/CasX, Cas12g, Cas12h, and Cas12i). See, e.g., Shmakov et al., "Discovery and Functional Characterization of Diverse Class 2 CRISPR Cas Systems," Mol. Cell, 2015 Nov. 5; 60(3): 385-397; Makarova et al., "Classification and Nomenclature of CRISPR-Cas Systems: Where from Here?" CRISPR Journal, 2018, 1(5): 325-336; and Yan et al., "Functionally Diverse Type V CRISPR-Cas Systems," Science, 2019 Jan. 4; 363: 88-91; the entire contents of each is hereby incorporated by reference. Type V Cas proteins contain a RuvC (or RuvC-like) endonuclease domain. While production of mature CRISPR RNA (crRNA) is generally tracrRNA-independent, Cas12b/C2c1, for example, requires tracrRNA for production of crRNA. Cas12b/C2c1 depends on both crRNA and tracrRNA for DNA cleavage.

Nucleic acid programmable DNA binding proteins contemplated in the present invention include Cas proteins that are classified as Class 2, Type V (Cas12 proteins). Non-limiting examples of Cas Class 2, Type V proteins include Cas12a/Cpf1, Cas12b/C2c1, Cas12c/C2c3, Cas12d/CasY, Cas12e/CasX, Cas12g, Cas12h, and Cas12i, homologues thereof, or modified versions thereof. As used herein, a Cas12 protein can also be referred to as a Cas12 nuclease, a Cas12 domain, or a Cas12 protein domain. In some embodiments, the Cas12 proteins of the present invention comprise an amino acid sequence interrupted by an internally fused protein domain such as a deaminase domain.

In some embodiments, the Cas12 domain is a nuclease inactive Cas12 domain or a Cas12 nickase. In some embodiments, the Cas12 domain is a nuclease active domain. For example, the Cas12 domain may be a Cas12 domain that nicks one strand of a duplexed nucleic acid (e.g., duplexed DNA molecule). In some embodiments, the Cas12 domain comprises any one of the amino acid sequences as set forth herein. In some embodiments the Cas12 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas12 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth herein. In some embodiments, the Cas12 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, proteins comprising fragments of Cas12 are provided. For example, in some embodiments, a protein comprises one of two Cas12 domains: (1) the gRNA binding domain of Cas12; or (2) the DNA cleavage domain of Cas12. In some embodiments, proteins comprising Cas12 or fragments thereof are referred to as "Cas12 variants." A Cas12 variant shares homology to Cas12, or a fragment thereof. For example, a Cas12 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas12. In some embodiments, the Cas12 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas12. In some embodiments, the Cas12 variant comprises a fragment of Cas12 (e.g., a gRNA binding domain or a DNA cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas12. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas12. In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In some embodiments, Cas12 corresponds to, or comprises in part or in whole, a Cas12 amino acid sequence having one or more mutations that alter the Cas12 nuclease activity. Such mutations, by way of example, include amino acid substitutions within the RuvC nuclease domain of Cas12. In some embodiments, variants or homologues of Cas12 are provided which are at least about 70% identical, at least about 80% identical, at least about 90% identical, at least about 95% identical, at least about 98% identical, at least about 99% identical, at least about 99.5% identical, or at least about 99.9% identical to a wild type Cas12. In some embodiments, variants of Cas12 are provided having amino acid sequences which are shorter, or longer, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas12 fusion proteins as provided herein comprise the full-length amino acid sequence of a Cas12 protein, e.g., one of the Cas12 sequences provided herein. In other embodiments, however, fusion proteins as provided herein do not comprise a full-length Cas12 sequence, but only one or more fragments thereof. Exemplary amino acid sequences of suitable Cas12 domains are provided herein, and additional suitable sequences of Cas12 domains and fragments will be apparent to those of skill in the art.

Generally, the class 2, Type V Cas proteins have a single functional RuvC endonuclease domain (See, e.g., Chen et al., "CRISPR-Cas12a target binding unleashes indiscriminate single-stranded DNase activity," Science 360:436-439 (2018)). In some cases, the Cas12 protein is a variant Cas12b protein. (See Strecker et al., Nature Communications, 2019, 10(1): Art. No.: 212). In one embodiment, a variant Cas12 polypeptide has an amino acid sequence that is different by 1, 2, 3, 4, 5 or more amino acids (e.g., has a deletion, insertion, substitution, fusion) when compared to the amino acid sequence of a wild type Cas12 protein. In some instances, the variant Cas12 polypeptide has an amino acid change (e.g., deletion, insertion, or substitution) that reduces the activity of the Cas12 polypeptide. For example, in some instances, the variant Cas12 is a Cas12b polypeptide that has less than 50%, less than 40%, less than 30%, less than 20%, less than 10%, less than 5%, or less than 1% of the nickase activity of the corresponding wild-type Cas12b protein. In some cases, the variant Cas12b protein has no substantial nickase activity.

In some cases, a variant Cas12b protein has reduced nickase activity. For example, a variant Cas12b protein exhibits less than about 20%, less than about 15%, less than about 10%, less than about 5%, less than about 1%, or less than about 0.1%, of the nickase activity of a wild-type Cas12b protein.

In some embodiments, the Cas12 protein includes RNA-guided endonucleases from the Cas12a/Cpf1 family that displays activity in mammalian cells. CRISPR from *Prevotella* and *Francisella* 1 (CRISPR/Cpf1) is a DNA editing technology analogous to the CRISPR/Cas9 system. Cpf1 is an RNA-guided endonuclease of a class II CRISPR/Cas system. This acquired immune mechanism is found in *Prevotella* and *Francisella* bacteria. Cpf1 genes are associated with the CRISPR locus, coding for an endonuclease that use a guide RNA to find and cleave viral DNA. Cpf1 is a smaller and simpler endonuclease than Cas9, overcoming some of the CRISPR/Cas9 system limitations. Unlike Cas9 nucleases, the result of Cpf1-mediated DNA cleavage is a double-strand break with a short 3' overhang. Cpf1's staggered cleavage pattern can open up the possibility of directional gene transfer, analogous to traditional restriction enzyme cloning, which can increase the efficiency of gene editing. Like the Cas9 variants and orthologues described above, Cpf1 can also expand the number of sites that can be targeted by CRISPR to AT-rich regions or AT-rich genomes that lack the NGG PAM sites favored by SpCas9. The Cpf1 locus contains a mixed alpha/beta domain, a RuvC-I followed by a helical region, a RuvC-II and a zinc finger-like domain. The Cpf1 protein has a RuvC-like endonuclease domain that is similar to the RuvC domain of Cas9. Furthermore, Cpf1, unlike Cas9, does not have a HNH endonuclease domain, and the N-terminal of Cpf1 does not have the alpha-helical recognition lobe of Cas9. Cpf1 CRISPR-Cas domain architecture shows that Cpf1 is functionally unique, being classified as Class 2, type V CRISPR system. The Cpf1 loci encode Cas 1, Cas2, and Cas4 proteins are more similar to types I and III than type II systems. Functional Cpf1 does not require the trans-activating CRISPR RNA (tracrRNA), therefore, only CRISPR (crRNA) is required. This benefits genome editing because Cpf1 is not only smaller than Cas9, but also it has a smaller sgRNA molecule (approximately half as many nucleotides as Cas9). The Cpf1-crRNA complex cleaves target DNA or RNA by identification of a protospacer adjacent motif 5'-YTN-3' or 5'-TTTN-3' in contrast to the G-rich PAM targeted by Cas9. After identification of PAM, Cpf1 introduces a sticky-end-like DNA double-stranded break having an overhang of 4 or 5 nucleotides.

In some aspects of the present invention, a vector encodes a CRISPR enzyme that is mutated to with respect to a corresponding wild-type enzyme such that the mutated CRISPR enzyme lacks the ability to cleave one or both strands of a target polynucleotide containing a target sequence can be used. Cas12 can refer to a polypeptide with at least or at least about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., Cas12 from *Bacillus hisashii*). Cas12 can refer to a polypeptide with at most or at most about 50%, 60%, 70%, 80%, 90%, 91%, 92%, 93%, 94%, 95%, 96%, 97%, 98%, 99%, or 100% sequence identity and/or sequence homology to a wild type exemplary Cas12 polypeptide (e.g., from *Bacillus hisashii* (BhCas12b), *Bacillus* sp. V3-13 (BvCas12b), and *Alicyclobacillus acidiphilus* (AaCas12b)). Cas12 can refer to the wild type or a modified form of the Cas12 protein that can comprise an amino acid change such as a deletion, insertion, substitution, variant, mutation, fusion, chimera, or any combination thereof.

Nucleic Acid Programmable DNA Binding Proteins

Some aspects of the disclosure provide fusion proteins comprising domains that act as nucleic acid programmable DNA binding proteins, which may be used to guide a protein, such as a base editor, to a specific nucleic acid (e.g., DNA or RNA) sequence. In particular embodiments, a fusion protein comprises a nucleic acid programmable DNA binding protein domain and a deaminase domain. Non-limiting examples of nucleic acid programmable DNA binding proteins include, Cas9 (e.g., dCas9 and nCas9), Cas12a/Cpf1, Cas12b/C2c1, Cas12c/C2c3, Cas12d/CasY, Cas12e/CasX, Cas12g, Cas12h, and Cas12i. Non-limiting examples of Cas enzymes include Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (also known as Csn1 or Csx12), Cas10, Cas10d, Cas12a/Cpf1, Cas12b/C2c1, Cas12c/C2c3, Cas12d/CasY, Cas12e/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, homologues thereof, or modified or engineered versions thereof. Other nucleic acid programmable DNA binding proteins are also within the scope of this disclosure, although they may not be specifically listed in this disclosure. See, e.g., Makarova et al. "Classification and Nomenclature of CRISPR-Cas Systems: Where from Here?" CRISPR J. 2018 October; 1:325-336. doi: 10.1089/crispr.2018.0033; Yan et al., "Functionally diverse type V CRISPR-Cas systems" Science. 2019 Jan. 4; 363(6422):88-91. doi: 10.1126/science.aav7271, the entire contents of each are hereby incorporated by reference.

One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells. Cpf1 proteins are known in the art and have been described previously, for example Yamano et al., "Crystal structure of Cpf1 in complex with guide RNA and target DNA. "*Cell* (165) 2016, p. 949-962; the entire contents of which is hereby incorporated by reference.

Useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have an HNH endonuclease domain, and the N-terminal of Cpf1 does not have the alfa-helical recognition lobe of Cas9. It was shown in Zetsche et al., *Cell*, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 inactivate Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a Cpf1 sequence disclosed herein. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a Cpf1 sequence disclosed herein, and comprises mutations corresponding to D917A, E1006A, D1255A, D917A/E1006A, D917A/D1255A, E1006A/D1255A, or D917A/E1006A/D1255A. It should be appreciated that Cpf1 from other bacterial species may also be used in accordance with the present disclosure.

Wild type *Francisella novicida* Cpf1 (D917, E1006, and D1255 are bolded and underlined):

(SEQ ID NO: 80)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

-continued

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

*Francisella novicida* Cpf1 D917A (A917, E1006, and D1255 are bolded and underlined):

(SEQ ID NO: 81)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIARGERHLAYYTLVDGKGNIIKQDTFNIIGNDRMK

TNYHDKLAAIEKDRDSARKDWKKINNIKEMKEGYLSQVVHEIAKLVIEYN

AIVVFEDLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

*Francisella novicida* Cpf1 E1006A (D917, A1006, and D1255 are bolded and underlined):

(SEQ ID NO: 82)
MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

-continued

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDIQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

NKNKDNPKKESVFEYDLIKDKRFTEDKFFFHCPITINFKSSGANKFNDEI

NLLLKEKANDVHILSIDRGERHLAYYTLVDGKGNIIKQDTFNIIGNDRMK

TNYHDKLAAIEKDRDSARKDWKKINNIKEMKEGYLSQVVHEIAKLVIEYN

AIVVFADLNFGFKRGRFKVEKQVYQKLEKMLIEKLNYLVFKDNEFDKTGG

VLRAYQLTAPFETFKKMGKQTGIIYYVPAGFTSKICPVTGFVNQLYPKYE

SVSKSQEFFSKFDKICYNLDKGYFEFSFDYKNFGDKAAKGKWTIASFGSR

LINFRNSDKNHNWDTREVYPTKELEKLLKDYSIEYGHGECIKAAICGESD

KKFFAKLTSVLNTILQMRNSKTGTELDYLISPVADVNGNFFDSRQAPKNM

PQDADANGAYHIGLKGLMLLGRIKNNQEGKKLNLVIKNEEYFEFVQNRNN

*Francisella novicida* Cpf1 D1255A (D917, E1006, and A1255 are bolded and underlined)

(SEQ ID NO: 83)

MSIYQEFVNKYSLSKTLRFELIPQGKTLENIKARGLILDDEKRAKDYKKA

KQIIDKYHQFFIEEILSSVCISEDLLQNYSDVYFKLKKSDDDNLQKDFKS

AKDTIKKQISEYIKDSEKFKNLFNQNLIDAKKGQESDLILWLKQSKDNGI

ELFKANSDITDIDEALEIIKSFKGWTTYFKGFHENRKNVYSSNDIPTSII

YRIVDDNLPKFLENKAKYESLKDKAPEAINYEQIKKDLAEELTFDIDYKT

SEVNQRVFSLDEVFEIANFNNYLNQSGITKFNTIIGGKFVNGENTKRKGI

NEYINLYSQQINDKTLKKYKMSVLFKQILSDTESKSFVIDKLEDDSDVVT

TMQSFYEQIAAFKTVEEKSIKETLSLLFDDLKAQKLDLSKIYFKNDKSLT

DLSQQVFDDYSVIGTAVLEYITQQIAPKNLDNPSKKEQELIAKKTEKAKY

LSLETIKLALEEFNKHRDIDKQCRFEEILANFAAIPMIFDEIAQNKDNLA

QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF

ENSTLANGWDKNKEPDNTAILFIKDDKYYLGVMNKKNNKIFDDKAIKENK

GEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSI

DEFYREVENQGYKLTFENISESYIDSVVNQGKLYLFQIYNKDFSAYSKGR

PNLHTLYWKALFDERNLQDVVYKLNGEAELFYRKQSIPKKITHPAKEAIA

-continued

NKNKDNPKKESVFEYDLIKDKRFTEDKFFFHCPITINFKSSGANKFNDEI
NLLLKEKANDVHILSIDRGERHLAYYTLVDGKGNIIKQDTFNIIGNDRMK
TNYHDKLAAIEKDRDSARKDWKKINNIKEMKEGYLSQVVHEIAKLVIEYN
AIVVFEDLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN

*Francisella novicida* Cpf1 D917A/E1006A (A917, A1006, and D1255 are bolded and underlined):

(SEQ ID NO: 84)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIARGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDADANGAYHIGLKGLMLLGRIKNNQEGKKLNLVIKNEEYFEFVQNRNN

*Francisella novicida* Cpf1 D917A/D1255A (A917, E1006, and A1255 are bolded and underlined):

(SEQ ID NO: 85)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIARGERHLAYYTLVDGKGNIIKQDTFNIIGNDRMK
TNYHDKLAAIEKDRDSARKDWKKINNIKEMKEGYLSQVVHEIAKLVIEYN
AIVVFEDLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN

*Francisella novicida* Cpf1 E1006A/D1255A (D917, A1006, and A1255 are bolded and underlined):

(SEQ ID NO: 86)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED

KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIDRGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN

*Francisella novicida* Cpf1 D917A/E1006A/D1255A (A917, A1006, and A1255 are bolded and underlined):

(SEQ ID NO: 87)
MSIYQEFVNKYSLSKTLRFELIPQGKTLENIKARGLILDDEKRAKDYKKA
KQIIDKYHQFFIEEILSSVCISEDLLQNYSDVYFKLKKSDDDNLQKDFKS
AKDTIKKQISEYIKDSEKFKNLFNQNLIDAKKGQESDLILWLKQSKDNGI
ELFKANSDITDIDEALEIIKSFKGWTTYFKGFHENRKNVYSSNDIPTSII
YRIVDDNLPKFLENKAKYESLKDKAPEAINYEQIKKDLAEELTFDIDYKT
SEVNQRVFSLDEVFEIANFNNYLNQSGITKFNTIIGGKFVNGENTKRKGI
NEYINLYSQQINDKTLKKYKMSVLFKQILSDTESKSFVIDKLEDDSDVVT
TMQSFYEQIAAFKTVEEKSIKETLSLLFDDLKAQKLDLSKIYFKNDKSLT
DLSQQVFDDYSVIGTAVLEYITQQIAPKNLDNPSKKEQELIAKKTEKAKY
LSLETIKLALEEFNKHRDIDKQCRFEEILANFAAIPMIFDEIAQNKDNLA
QISIKYQNQGKKDLLQASAEDDVKAIKDLLDQTNNLLHKLKIFHISQSED
KANILDKDEHFYLVFEECYFELANIVPLYNKIRNYITQKPYSDEKFKLNF
ENSTLANGWDKNKEPDNTAILFIKDDKYYLGVMNKKNNKIFDDKAIKENK
GEGYKKIVYKLLPGANKMLPKVFFSAKSIKFYNPSEDILRIRNHSTHTKN
GSPQKGYEKFEFNIEDCRKFIDFYKQSISKHPEWKDFGFRFSDTQRYNSI
DEFYREVENQGYKLTFENISESYIDSVVNQGKLYLFQIYNKDFSAYSKGR
PNLHTLYWKALFDERNLQDVVYKLNGEAELFYRKQSIPKKITHPAKEAIA
NKNKDNPKKESVFEYDLIKDKRFTEDKFFFHCPITINFKSSGANKFNDEI
NLLLKEKANDVHILSIARGERHLAYYTLVDGKGNIIKQDTFNIIGNDRMK
TNYHDKLAAIEKDRDSARKDWKKINNIKEMKEGYLSQVVHEIAKLVIEYN
AIVVFADLNFGFKRGRFKVEKQVYQKLEKMLIEKLNYLVFKDNEFDKTGG
VLRAYQLTAPFETFKKMGKQTGIIYYVPAGFTSKICPVTGFVNQLYPKYE
SVSKSQEFFSKFDKICYNLDKGYFEFSFDYKNFGDKAAKGKWTIASFGSR
LINFRNSDKNHNWDTREVYPTKELEKLLKDYSIEYGHGECIKAAICGESD
KKFFAKLTSVLNTILQMRNSKTGTELDYLISPVADVNGNFFDSRQAPKNM
PQDAAANGAYHIGLKGLMLLGRIKNNQEGKKLNLVIKNEEYFEFVQNRNN

In some embodiments, one of the Cas9 domains present in the fusion protein may be replaced with a guide nucleotide sequence-programmable DNA-binding protein domain that has no requirements for a PAM sequence.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises a N579A mutation, or a corresponding mutation in any of the amino acid sequences provided herein.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT or a NNGRRT PAM sequence. In some embodiments, the SaCas9 domain comprises one or more of a E781X, a N967X, and a R1014X mutation, or a corresponding mutation in any of the amino acid sequences provided herein, wherein X is any amino acid. In some embodiments, the SaCas9 domain comprises one or more of a E781K, a N967K, and a R1014H mutation, or one or more corresponding mutation in any of the amino acid sequences provided herein. In some embodiments, the SaCas9 domain comprises a E781K, a N967K, or a R1014H mutation, or corresponding mutations in any of the amino acid sequences provided herein.

Exemplary SaCas9 Sequence:

(SEQ ID NO: 88)
KRNYILGLDIGITSVGYGIIDYETRDVIDAGVRLFKEANVENNEGRRSKR
GARRLKRRRRHRIQRVKKLLFDYNLLTDHSELSGINPYEARVKGLSQKLS
EEEFSAALLHLAKRRGVHNVNEVEEDTGNELSTKEQISRNSKALEEKYVA
ELQLERLKKDGEVRGSINRFKTSDYVKEAKQLLKVQKAYHQLDQSFIDTY
IDLLETRRTYYEGPGEGSPFGWKDIKEWYEMLMGHCTYFPEELRSVKYAY
NADLYNALNDLNNLVITRDENEKLEYYEKFQIIENVFKQKKKPTLKQIAK
EILVNEEDIKGYRVTSTGKPEFTNLKVYHDIKDITARKEIIENAELLDQI
AKILTIYQSSEDIQEELTNLNSELTQEEIEQISNLKGYTGTHNLSLKAIN
LILDELWHTNDNQIAIFNRLKLVPKKVDLSQQKEIPTTLVDDFILSPVVK
RSFIQSIKVINAIIKKYGLPNDIIIELAREKNSKDAQKMINEMQKRNRQT
NERIEEIIRTTGKENAKYLIEKIKLHDMQEGKCLYSLEAIPLEDLLNNPF
NYEVDHIIPRSVSFDNSFNNKVLVKQEENSKKGNRTPFQYLSSSDSKISY
ETFKKHILNLAKGKGRISKTKKEYLLEERDINRFSVQKDFINRNLVDTRY
ATRGLMNLLRSYFRVNNLDVKVKSINGGFTSFLRRKWKFKKERNKGYKHH
AEDALIIANADFIFKEWKKLDKAKKVMENQMFEEKQAESMPEIETEQEYK
EIFITPHQIKHIKDFKDYKYSHRVDKKPNRELINDTLYSTRKDDKGNTLI
VNNLNGLYDKDNDKLKKLINKSPEKLLMYHHDPQTYQKLKLIMEQYGDEK

-continued
```
NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG
```

Residue N579 above, which is underlined and in bold, may be mutated (e.g., to a A579) to yield a SaCas9 nickase.
Exemplary SaCas9n Sequence:

```
                                          (SEQ ID NO: 89)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRELINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYNNDLIKINGELYRVIGVNNDLLNRIEVNMIDITY

REYLENMNDKRPPRIIKTIASKTQSIKKYSTDILGNLYEVKSKKHPQIIK

KG
```

Residue A579 above, which can be mutated from N579 to yield a SaCas9 nickase, is underlined and in bold.
Exemplary SaKKH Cas9:

```
                                          (SEQ ID NO: 90)
KRNYILGLDIGITSVGYGIIDYETRDVIDAGVRLFKEANVENNEGRRSKR

GARRLKRRRRHRIQRVKKLLFDYNLLTDHSELSGINPYEARVKGLSQKLS

EEEFSAALLHLAKRRGVHNVNEVEEDTGNELSTKEQISRNSKALEEKYVA

ELQLERLKKDGEVRGSINRFKTSDYVKEAKQLLKVQKAYHQLDQSFIDTY

IDLLETRRTYYEGPGEGSPFGWKDIKEWYEMLMGHCTYFPEELRSVKYAY

NADLYNALNDLNNLVITRDENEKLEYYEKFQIIENVFKQKKKPTLKQIAK

EILVNEEDIKGYRVTSTGKPEFTNLKVYHDIKDITARKEIIENAELLDQI

AKILTIYQSSEDIQEELTNLNSELTQEEIEQISNLKGYTGTHNLSLKAIN

LILDELWHTNDNQIAIFNRLKLVPKKVDLSQQKEIPTTLVDDFILSPVVK

RSFIQSIKVINAIIKKYGLPNDIIIELAREKNSKDAQKMINEMQKRNRQT

NERIEEIIRTTGKENAKYLIEKIKLHDMQEGKCLYSLEAIPLEDLLNNPF

NYEVDHIIPRSVSFDNSFNNKVLVKQEEASKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITY

REYLENMNDKRPPHIIKTIASKTQSIKKYSTDILGNLYEVKSKKHPQIIK

KG.
```

Residue A579 above, which can be mutated from N579 to yield a SaCas9 nickase, is underlined and in bold. Residues K781, K967, and H1014 above, which can be mutated from E781, N967, and R1014 to yield a SaKKH Cas9 are underlined and in italics.

In some embodiments, the napDNAbp is a circular permutant. In the following sequences, the plain text denotes an adenosine deaminase sequence, bold sequence indicates sequence derived from Cas9, the italics sequence denotes a linker sequence, and the underlined sequence denotes a bipartite nuclear localization sequence.
CP5 (with MSP "NGC" PID and "D10A" Nickase):

```
                                          (SEQ ID NO: 3)
EIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWD

PKKYGGFMQPTVAYSVLVVAKVEKGKSKKLKSVKELLGITIMERSSFEKN

PIDFLEAKGYKEVKKDLIIKLPKYSLFELENGRKRMLASAKFLQKGNELA

LPSKYVNFLYLASHYEKLKGSPEDNEQKQLFVEQHKHYLDEIIEQISEFS

KRVILADANLDKVLSAYNKHRDKPIREQAENIIHLFTLTNLGAPRAFKYF

DTTIARKEYRSTKEVLDATLIHQSITGLYETRIDLSQLGGDGGSGGSGGS

GGSGGSGGSGGMDKKYSIGLAIGTNSVGWAVITDEYKVPSKKFKVLGNTD

RHSIKKNLIGALLFDSGETAEATRLKRTARRRYTRRKNRICYLQEIFSNE

MAKVDDSFFHRLEESFLVEEDKKHERHPIFGNIVDEVAYHEKYPTIYHLR

KKLVDSTDKADLRLIYLALAHMIKFRGHFLIEGDLNPDNSDVDKLFIQLV

QTYNQLFEENPINASGVDAKAILSARLSKSRRLENLIAQLPGEKKNGLFG

NLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALV

RQQLPEKYKEIFFDQSKNGYAGYIDGGASQEEFYKFIKPILEKMDGTEEL

LVKLNREDLLRKQRTFDNGSIPHQIHLGELHAILRRQEDFYPFLKDNREK
```

```
-continued
IEKILTFRIPYYVGPLARGNSRFAWMTRKSEETITPWNFEEVVDKGASAQ

SFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQ

TVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVD

HIVPQSFLKDDSIDNKVLTRSDKNRGKSDNVPSEEVVKKMKNYWRQLLNA

KLITQRKFDNLTKAERGGLSELDKAGFIKRQLVETRQITKHVAQILDSRM

NTKYDENDKLIREVKVITLKSKLVSDFRKDFQFYKVREINNYHHAHDAYL

NAVVGTALIKKYPKLESEFVYGDYKVYDVRKMIAKSEQEGADKRTADGSE

FESPKKKRKV*
```

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, Cas12b/C2c1, and Cas12c/C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (Cas12b/C2c1, and Cas12c/C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, Cas12b/C2c1, and Cas12c/C2c3, contain RuvC-like endonuclease domains related to Cpf1. A third system contains an effector with two predicated HEPN RNase domains. Production of mature CRISPR RNA is tracrRNA-independent, unlike production of CRISPR RNA by Cas12b/C2c1. Cas12b/C2c1 depends on both CRISPR RNA and tracrRNA for DNA cleavage.

The crystal structure of *Alicyclobaccillus acidoterrastris* Cas12b/C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", Mol. Cell, 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", Cell, 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with Cas12b/C2c1-mediated cleavage resulting in a staggered seven-nucleotide break of target DNA. Structural comparisons between Cas12b/C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a Cas12b/C2c1, or a Cas12c/C2c3 protein. In some embodiments, the napDNAbp is a Cas12b/C2c1 protein. In some embodiments, the napDNAbp is a Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring Cas12b/C2c1 or Cas12c/C2c3 protein. In some embodiments, the napDNAbp is a naturally-occurring Cas12b/C2c1 or Cas12c/C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of the napDNAbp sequences provided herein. It should be appreciated that Cas12b/C2c1 or Cas12c/C2c3 from other bacterial species may also be used in accordance with the present disclosure.

A Cas12b/C2c1 ((uniprot.org/uniprot/T0D7A2#2) sp|T0D7A2|C2C1_ALIAG CRISPR-associated endonuclease C2c1 OS=*Alicyclobacillus acido-terrestris* (strain ATCC 49025/DSM 3922/CIP 106132/NCIMB 13137/GD3B) GN=c2c1 PE=1 SV=1) amino acid sequence is as follows:

```
                                            (SEQ ID NO: 39)
MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR

MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPFSAEEGDFHQIHADLNAAQNLQQRLWSDFDISQIRLR

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI
```

BhCas12b (*Bacillus hisashii*) NCBI Reference Sequence: WP_095142515

(SEQ ID NO: 91)
MAPKKKRKVGIHGVPAAATRSFILKIEPNEEVKKGLWKTHEVLNHGIAYY

MNILKLIRQEAIYEHHEQDPKNPKKVSKAEIQAELWDFVLKMQKCNSFTH

EVDKDEVFNILRELYEELVPSSVEKKGEANQLSNKFLYPLVDPNSQSGKG

TASSGRKPRWYNLKIAGDPSWEEEKKKWEEDKKKDPLAKILGKLAEYGLI

PLFIPYTDSNEPIVKEIKWMEKSRNQSVRRLDKDMFIQALERFLSWESWN

LKVKEEYEKVEKEYKTLEERIKEDIQALKALEQYEKERQEQLLRDTLNTN

EYRLSKRGLRGWREIIQKWLKMDENEPSEKYLEVFKDYQRKHPREAGDYS

VYEFLSKKENHFIWRNHPEYPYLYATFCEIDKKKKDAKQQATFTLADPIN

HPLWVRFEERSGSNLNKYRILTEQLHTEKLKKKLTVQLDRLIYPTESGGW

EEKGKVDIVLLPSRQFYNQIFLDIEEKGKHAFTYKDESIKFPLKGTLGGA

RVQFDRDHLRRYPHKVESGNVGRIYFNMTVNIEPTESPVSKSLKIHRDDF

PKVVNFKPKELTEWIKDSKGKKLKSGIESLEIGLRVMSIDLGQRQAAAAS

IFEVVDQKPDIEGKLFFPIKGTELYAVHRASFNIKLPGETLVKSREVLRK

AREDNLKLMNQKLNFLRNVLHFQQFEDITEREKRVTKWISRQENSDVPLV

YQDELIQIRELMYKPYKDWVAFLKQLHKRLEVEIGKEVKHWRKSLSDGRK

GLYGISLKNIDEIDRTRKFLLRWSLRPTEPGEVRRLEPGQRFAIDQLNHL

NALKEDRLKKMANTIIMHALGYCYDVRKKKWQAKNPACQIILFEDLSNYN

PYEERSRFENSKLMKWSRREIPRQVALQGEIYGLQVGEVGAQFSSRFHAK

TGSPGIRCSVVTKEKLQDNRFFKNLQREGRLTLDKIAVLKEGDLYPDKGG

EKFISLSKDRKCVTTHADINAAQNLQKRFWTRTHGFYKVYCKAYQVDGQT

VYIPESKDQKQKIIEEFGEGYFILKDGVYEWVNAGKLKIKKGSSKQSSSE

LVDSDILKDSFDLASELKGEKLMLYRDPSGNVFPSDKWMAAGVFFGKLER

ILISKLTNQYSISTIEDDSSKQSMKRPAATKKAGQAKKKK

In some embodiments, the Cas12b is BvCas12B. In some embodiments, the Cas12b comprises amino acid substitutions S893R, K846R, and E837G, as numbered in the exemplary BvCas12b amino acid sequence provided below. BvCas12b (*Bacillus* sp. V3-13) NCBI Reference Sequence: WP_101661451.1:

(SEQ ID NO: 92)
MAIRSIKLKMKTNSGTDSIYLRKALWRTHQLINEGIAYYMNLLTLYRQEA

IGDKTKEAYQAELINIIRNQQRNNGSSEEHGSDQEILALLRQLYELIIPS

SIGESGDANQLGNKFLYPLVDPNSQSGKGTSNAGRKPRWKRLKEEGNPDW

ELEKKKDEERKAKDPTVKIFDNLNKYGLLPLFPLFTNIQKDIEWLPLGKR

QSVRKWDKDMFIQAIERLLSWESWNRRVADEYKQLKEKTESYYKEHLTGG

EEWIEKIRKFEKERNMELEKNAFAPNDGYFITSRQIRGWDRVYEKWSKLP

ESASPEELWKVVAEQQNKMSEGFGDPKVFSFLANRENRDIWRGHSERIYH

IAAYNGLQKKLSRTKEQATFTLPDAIEHPLWIRYESPGGTNLNLFKLEEK

QKKNYYVTLSKIIWPSEEKWIEKENIEIPLAPSIQFNRQIKLKQHVKGKQ

EISFSDYSSRISLDGVLGGSRIQFNRKYIKNHKELLGEGDIGPVFFNLVV

DVAPLQETRNGRLQSPIGKALKVISSDFSKVIDYKPKELMDWMNTGSASN

SFGVASLLEGMRVMSIDMGQRTSASVSIFEVVKELPKDQEQKLFYSINDT

ELFAIHKRSFLLNLPGEVVTKNNKQQRQERRKKRQFVRSQIRMLANVLRL

ETKKTPDERKKAIHKLMEIVQSYDSWTASQKEVWEKELNLLTNMAAFNDE

IWKESLVELHHRIEPYVGQIVSKWRKGLSEGRKNLAGISMWNIDELEDTR

RLLISWSKRSRTPGEANRIETDEPFGSSLLQHIQNVKDDRLKQMANLIIM

TALGFKYDKEEKDRYKRWKETYPACQIILFENLNRYLFNLDRSRRENSRL

MKWAHRSIPRTVSMQGEMFGLQVGDVRSEYSSRFHAKTGAPGIRCHALTE

EDLKAGSNTLKRLIEDGFINESELAYLKKGDIIPSQGGELFVTLSKRYKK

DSDNNELTVIHADINAAQNLQKRFWQQNSEVYRVPCQLARMGEDKLYIPK

SQTETIKKYFGKGSFVKNNTEQEVYKWEKSEKMKIKTDTTFDLQDLDGFE

DISKTIELAQEQQKKYLTMFRDPSGYFFNNETWRPQKEYWSIVNNIIKSC

LKKKILSNKVEL

Guide Polynucleotides

In an embodiment, the guide polynucleotide is a guide RNA. An RNA/Cas complex can assist in "guiding" Cas protein to a target DNA. Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA," or simply "gNRA") can be engineered so as to incorporate aspects of both the crRNA and tracrRNA into a single RNA species. See, e.g., Jinek M. et al., Science 337:816-821 (2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see e.g., "Complete genome sequence of an M1 strain of *Streptococcus pyogenes*." Ferretti, J. J. et al., Natl. Acad. Sci. U.S.A. 98:4658-4663 (2001); "CRISPR RNA maturation by trans-encoded small RNA and host factor RNase III." Deltcheva E. et al., Nature 471:602-607 (2011); and "Programmable dual-RNA-guided DNA endonuclease in adaptive bacterial immunity." Jinek M. et al, Science 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences can be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

In some embodiments, the guide polynucleotide is at least one single guide RNA ("sgRNA" or "gNRA"). In some embodiments, the guide polynucleotide is at least one tracrRNA. In some embodiments, the guide polynucleotide does not require PAM sequence to guide the polynucleotide-programmable DNA-binding domain (e.g., Cas9 or Cpf1) to the target nucleotide sequence.

The polynucleotide programmable nucleotide binding domain (e.g., a CRISPR-derived domain) of the base editors disclosed herein can recognize a target polynucleotide sequence by associating with a guide polynucleotide. A guide polynucleotide (e.g., gRNA) is typically single-stranded and can be programmed to site-specifically bind (i.e., via complementary base pairing) to a target sequence of a polynucleotide, thereby directing a base editor that is in conjunction with the guide nucleic acid to the target sequence. A guide polynucleotide can be DNA. A guide polynucleotide can be RNA. In some embodiments, the guide polynucleotide comprises natural nucleotides (e.g., adenosine). In some embodiments, the guide polynucleotide comprises non-natural (or unnatural) nucleotides (e.g., peptide nucleic acid or nucleotide analogs). In some embodiments, the targeting region of a guide nucleic acid sequence can be at least 15, 16, 17, 18, 19, 20, 21, 22, 23, 24, 25, 26, 27, 28, 29, or 30 nucleotides in length. A targeting region of a guide nucleic acid can be between 10-30 nucleotides in length, or between 15-25 nucleotides in length, or between 15-20 nucleotides in length.

In some embodiments, a guide polynucleotide comprises two or more individual polynucleotides, which can interact with one another via for example complementary base pairing (e.g., a dual guide polynucleotide). For example, a guide polynucleotide can comprise a CRISPR RNA (crRNA) and a trans-activating CRISPR RNA (tracrRNA). For example, a guide polynucleotide can comprise one or more trans-activating CRISPR RNA (tracrRNA).

In type II CRISPR systems, targeting of a nucleic acid by a CRISPR protein (e.g., Cas9) typically requires complementary base pairing between a first RNA molecule (crRNA) comprising a sequence that recognizes the target sequence and a second RNA molecule (trRNA) comprising repeat sequences which forms a scaffold region that stabilizes the guide RNA-CRISPR protein complex. Such dual guide RNA systems can be employed as a guide polynucleotide to direct the base editors disclosed herein to a target polynucleotide sequence.

In some embodiments, the base editor provided herein utilizes a single guide polynucleotide (e.g., gRNA). In some embodiments, the base editor provided herein utilizes a dual guide polynucleotide (e.g., dual gRNAs). In some embodiments, the base editor provided herein utilizes one or more guide polynucleotide (e.g., multiple gRNA). In some embodiments, a single guide polynucleotide is utilized for different base editors described herein. For example, a single guide polynucleotide can be utilized for an adenosine base editor, or for an adenosine base editor and a cytidine base editor, e.g., as described in PCT/US19/44935.

In other embodiments, a guide polynucleotide can comprise both the polynucleotide targeting portion of the nucleic acid and the scaffold portion of the nucleic acid in a single molecule (i.e., a single-molecule guide nucleic acid). For example, a single-molecule guide polynucleotide can be a single guide RNA (sgRNA or gRNA). Herein the term guide polynucleotide sequence contemplates any single, dual or multi-molecule nucleic acid capable of interacting with and directing a base editor to a target polynucleotide sequence.

Typically, a guide polynucleotide (e.g., crRNA/trRNA complex or a gRNA) comprises a "polynucleotide-targeting segment" that includes a sequence capable of recognizing and binding to a target polynucleotide sequence, and a "protein-binding segment" that stabilizes the guide polynucleotide within a polynucleotide programmable nucleotide binding domain component of a base editor. In some embodiments, the polynucleotide targeting segment of the guide polynucleotide recognizes and binds to a DNA polynucleotide, thereby facilitating the editing of a base in DNA. In other cases, the polynucleotide targeting segment of the guide polynucleotide recognizes and binds to an RNA polynucleotide, thereby facilitating the editing of a base in RNA. Herein a "segment" refers to a section or region of a molecule, e.g., a contiguous stretch of nucleotides in the guide polynucleotide. A segment can also refer to a region/section of a complex such that a segment can comprise regions of more than one molecule. For example, where a guide polynucleotide comprises multiple nucleic acid molecules, the protein-binding segment of can include all or a portion of multiple separate molecules that are for instance hybridized along a region of complementarity. In some embodiments, a protein-binding segment of a DNA-targeting RNA that comprises two separate molecules can comprise (i) base pairs 40-75 of a first RNA molecule that is 100 base pairs in length; and (ii) base pairs 10-25 of a second RNA molecule that is 50 base pairs in length. The definition of "segment," unless otherwise specifically defined in a particular context, is not limited to a specific number of total base pairs, is not limited to any particular number of base pairs from a given RNA molecule, is not limited to a particular number of separate molecules within a complex, and can include regions of RNA molecules that are of any total length and can include regions with complementarity to other molecules.

A guide RNA or a guide polynucleotide can comprise two or more RNAs, e.g., CRISPR RNA (crRNA) and transactivating crRNA (tracrRNA). A guide RNA or a guide polynucleotide can sometimes comprise a single-chain RNA, or single guide RNA (sgRNA) formed by fusion of a portion (e.g., a functional portion) of crRNA and tracrRNA. A guide RNA or a guide polynucleotide can also be a dual RNA comprising a crRNA and a tracrRNA. Furthermore, a crRNA can hybridize with a target DNA.

As discussed above, a guide RNA or a guide polynucleotide can be an expression product. For example, a DNA that encodes a guide RNA can be a vector comprising a sequence coding for the guide RNA. A guide RNA or a guide polynucleotide can be transferred into a cell by transfecting the cell with an isolated guide RNA or plasmid DNA comprising a sequence coding for the guide RNA and a promoter. A guide RNA or a guide polynucleotide can also be transferred into a cell in other way, such as using virus-mediated gene delivery.

A guide RNA or a guide polynucleotide can be isolated. For example, a guide RNA can be transfected in the form of an isolated RNA into a cell or organism. A guide RNA can be prepared by in vitro transcription using any in vitro transcription system known in the art. A guide RNA can be transferred to a cell in the form of isolated RNA rather than in the form of plasmid comprising encoding sequence for a guide RNA.

A guide RNA or a guide polynucleotide can comprise three regions: a first region at the 5' end that can be complementary to a target site in a chromosomal sequence, a second internal region that can form a stem loop structure, and a third 3' region that can be single-stranded. A first region of each guide RNA can also be different such that each guide RNA guides a fusion protein to a specific target site. Further, second and third regions of each guide RNA can be identical in all guide RNAs.

A first region of a guide RNA or a guide polynucleotide can be complementary to sequence at a target site in a chromosomal sequence such that the first region of the guide RNA can base pair with the target site. In some embodiments, a first region of a guide RNA can comprise from or from about 10 nucleotides to 25 nucleotides (i.e., from 10 nucleotides to nucleotides; or from about 10 nucleotides to about 25 nucleotides; or from 10 nucleotides to about 25 nucleotides); or from about 10 nucleotides to 25 nucleotides) or more. For example, a region of base pairing between a first region of a guide RNA and a target site in a chromosomal sequence can be or can be about 10, 11, 12, 13, 14, 15, 16, 17, 18, 19, 20, 22, 23, 24, 25, or more nucleotides in length. Sometimes, a first region of a guide RNA can be or can be about 19, 20, or 21 nucleotides in length.

A guide RNA or a guide polynucleotide can also comprise a second region that forms a secondary structure. For example, a secondary structure formed by a guide RNA can comprise a stem (or hairpin) and a loop. A length of a loop and a stem can vary. For example, a loop can range from or from about 3 to 10 nucleotides in length, and a stem can range from or from about 6 to 20 base pairs in length. A stem can comprise one or more bulges of 1 to 10 or about 10 nucleotides. The overall length of a second region can range from or from about 16 to 60 nucleotides in length. For example, a loop can be or can be about 4 nucleotides in length and a stem can be or can be about 12 base pairs.

A guide RNA or a guide polynucleotide can also comprise a third region at the 3' end that can be essentially single-stranded. For example, a third region is sometimes not complementarity to any chromosomal sequence in a cell of interest and is sometimes not complementarity to the rest of a guide RNA. Further, the length of a third region can vary. A third region can be more than or more than about 4 nucleotides in length. For example, the length of a third region can range from or from about 5 to 60 nucleotides in length.

A guide RNA or a guide polynucleotide can target any exon or intron of a gene target. In some embodiments, a guide can target exon 1 or 2 of a gene, in other cases; a guide can target exon 3 or 4 of a gene. A composition can comprise multiple guide RNAs that all target the same exon or In some embodiments, multiple guide RNAs that can target different exons. An exon and an intron of a gene can be targeted.

A guide RNA or a guide polynucleotide can target a nucleic acid sequence of or of about 20 nucleotides. A target nucleic acid can be less than or less than about 20 nucleotides. A target nucleic acid can be at least or at least about 5, 10, 15, 16, 17, 18, 19, 20, 21, 22, 23, 24, 25, 30, or anywhere between 1-100 nucleotides in length. A target nucleic acid can be at most or at most about 5, 10, 15, 16, 17, 18, 19, 20, 21, 22, 23, 24, 25, 30, 40, 50, or anywhere between 1-100 nucleotides in length. A target nucleic acid sequence can be or can be about 20 bases immediately 5' of the first nucleotide of the PAM. A guide RNA can target a nucleic acid sequence. A target nucleic acid can be at least or at least about 1-10, 1-20, 1-30, 1-40, 1-50, 1-60, 1-70, 1-80, 1-90, or 1-100 nucleotides.

A guide polynucleotide, for example, a guide RNA, can refer to a nucleic acid that can hybridize to another nucleic acid, for example, the target nucleic acid or protospacer in a genome of a cell. A guide polynucleotide can be RNA. A guide polynucleotide can be DNA. The guide polynucleotide can be programmed or designed to bind to a sequence of nucleic acid site-specifically. A guide polynucleotide can comprise a polynucleotide chain and can be called a single guide polynucleotide. A guide polynucleotide can comprise two polynucleotide chains and can be called a double guide polynucleotide. A guide RNA can be introduced into a cell or embryo as an RNA molecule. For example, a RNA molecule can be transcribed in vitro and/or can be chemically synthesized. An RNA can be transcribed from a synthetic DNA molecule, e.g., a gBlocks® gene fragment. A guide RNA can then be introduced into a cell or embryo as an RNA molecule. A guide RNA can also be introduced into a cell or embryo in the form of a non-RNA nucleic acid molecule, e.g., DNA molecule. For example, a DNA encoding a guide RNA can be operably linked to promoter control sequence for expression of the guide RNA in a cell or embryo of interest. An RNA coding sequence can be operably linked to a promoter sequence that is recognized by RNA polymerase III (Pol III). Plasmid vectors that can be used to express guide RNA include, but are not limited to, px330 vectors and px333 vectors. In some embodiments, a plasmid vector (e.g., px333 vector) can comprise at least two guide RNA-encoding DNA sequences.

Methods for selecting, designing, and validating guide polynucleotides, e.g., guide RNAs and targeting sequences are described herein and known to those skilled in the art. For example, to minimize the impact of potential substrate promiscuity of a deaminase domain in the nucleobase editor system (e.g., an AID domain), the number of residues that could unintentionally be targeted for deamination (e.g., off-target C residues that could potentially reside on ssDNA within the target nucleic acid locus) may be minimized. In addition, software tools can be used to optimize the gRNAs corresponding to a target nucleic acid sequence, e.g., to minimize total off-target activity across the genome. For example, for each possible targeting domain choice using *S. pyogenes* Cas9, all off-target sequences (preceding selected PAMs, e.g., NAG or NGG) may be identified across the genome that contain up to certain number (e.g., 1, 2, 3, 4, 5, 6, 7, 8, 9, or 10) of mismatched base-pairs. First regions of gRNAs complementary to a target site can be identified, and all first regions (e.g., crRNAs) can be ranked according to its total predicted off-target score; the top-ranked targeting domains represent those that are likely to have the greatest on-target and the least off-target activity. Candidate targeting gRNAs can be functionally evaluated by using methods known in the art and/or as set forth herein.

As a non-limiting example, target DNA hybridizing sequences in crRNAs of a guide RNA for use with Cas9s may be identified using a DNA sequence searching algorithm. gRNA design may be carried out using custom gRNA design software based on the public tool cas-offinder as described in Bae S., Park J., & Kim J.-S. Cas-OFFinder: A fast and versatile algorithm that searches for potential off-target sites of Cas9 RNA-guided endonucleases. Bioinformatics 30, 1473-1475 (2014). This software scores guides after calculating their genome-wide off-target propensity. Typically matches ranging from perfect matches to 7 mismatches are considered for guides ranging in length from 17 to 24. Once the off-target sites are computationally-determined, an aggregate score is calculated for each guide and summarized in a tabular output using a web-interface. In addition to identifying potential target sites adjacent to PAM sequences, the software also identifies all PAM adjacent sequences that differ by 1, 2, 3 or more than 3 nucleotides from the selected target sites. Genomic DNA sequences for a target nucleic acid sequence, e.g., a target gene may be obtained and repeat elements may be screened using publicly available tools, for example, the RepeatMasker program. RepeatMasker searches input DNA sequences for repeated elements and regions of low complexity. The output is a detailed annotation of the repeats present in a given query sequence.

Following identification, first regions of guide RNAs, e.g., crRNAs, may be ranked into tiers based on their distance to the target site, their orthogonality and presence of 5' nucleotides for close matches with relevant PAM sequences (for example, a 5' G based on identification of close matches in the human genome containing a relevant PAM e.g., NGG PAM for *S. pyogenes*, NNGRRT or NNGRRV PAM for *S. aureus*). As used herein, orthogonality refers to the number of sequences in the human genome that contain a minimum number of mismatches to the target sequence. A "high level of orthogonality" or "good orthogonality" may, for example, refer to 20-mer targeting domains that have no identical sequences in the human genome besides the intended target, nor any sequences that contain one or two mismatches in the target sequence. Targeting domains with good orthogonality may be selected to minimize off-target DNA cleavage.

In some embodiments, a reporter system may be used for detecting base-editing activity and testing candidate guide polynucleotides. In some embodiments, a reporter system may comprise a reporter gene-based assay where base editing activity leads to expression of the reporter gene. For example, a reporter system may include a reporter gene comprising a deactivated start codon, e.g., a mutation on the template strand from 3'-TAC-5' to 3'-CAC-5'. Upon successful deamination of the target C, the corresponding mRNA will be transcribed as 5'-AUG-3' instead of 5'-GUG-3', enabling the translation of the reporter gene. Suitable reporter genes will be apparent to those of skill in the art. Non-limiting examples of reporter genes include gene encoding green fluorescence protein (GFP), red fluorescence protein (RFP), luciferase, secreted alkaline phosphatase (SEAP), or any other gene whose expression are detectable and apparent to those skilled in the art. The reporter system can be used to test many different gRNAs, e.g., in order to determine which residue(s) with respect to the target DNA sequence the respective deaminase will target. sgRNAs that target non-template strand can also be tested in order to assess off-target effects of a specific base editing protein, e.g., a Cas9 deaminase fusion protein. In some embodiments, such gRNAs can be designed such that the mutated start codon will not be base-paired with the gRNA. The guide polynucleotides can comprise standard ribonucleotides, modified ribonucleotides (e.g., pseudouridine), ribonucleotide isomers, and/or ribonucleotide analogs. In some embodiments, the guide polynucleotide can comprise at least one detectable label. The detectable label can be a fluorophore (e.g., FAM, TMR, Cy3, Cy5, Texas Red, Oregon Green, Alexa Fluors, Halo tags, or suitable fluorescent dye), a detection tag (e.g., biotin, digoxigenin, and the like), quantum dots, or gold particles.

The guide polynucleotides can be synthesized chemically, synthesized enzymatically, or a combination thereof. For example, the guide RNA can be synthesized using standard phosphoramidite-based solid-phase synthesis methods. Alternatively, the guide RNA can be synthesized in vitro by operably linking DNA encoding the guide RNA to a promoter control sequence that is recognized by a phage RNA polymerase. Examples of suitable phage promoter sequences include T7, T3, SP6 promoter sequences, or variations thereof. In embodiments in which the guide RNA comprises two separate molecules (e.g., crRNA and tracrRNA), the crRNA can be chemically synthesized and the tracrRNA can be enzymatically synthesized.

In some embodiments, a base editor system may comprise multiple guide polynucleotides, e.g., gRNAs. For example, the gRNAs may target to one or more target loci (e.g., at least 1 gRNA, at least 2 gRNA, at least 5 gRNA, at least 10 gRNA, at least 20 gRNA, at least 30 g RNA, at least 50 gRNA) comprised in a base editor system. The multiple gRNA sequences can be tandemly arranged and are preferably separated by a direct repeat.

A DNA sequence encoding a guide RNA or a guide polynucleotide can also be part of a vector. Further, a vector can comprise additional expression control sequences (e.g., enhancer sequences, Kozak sequences, polyadenylation sequences, transcriptional termination sequences, etc.), selectable marker sequences (e.g., GFP or antibiotic resistance genes such as puromycin), origins of replication, and the like. A DNA molecule encoding a guide RNA can also be linear. A DNA molecule encoding a guide RNA or a guide polynucleotide can also be circular.

In some embodiments, one or more components of a base editor system may be encoded by DNA sequences. Such DNA sequences may be introduced into an expression system, e.g., a cell, together or separately. For example, DNA sequences encoding a polynucleotide programmable nucleotide binding domain and a guide RNA may be introduced into a cell, each DNA sequence can be part of a separate molecule (e.g., one vector containing the polynucleotide programmable nucleotide binding domain coding sequence and a second vector containing the guide RNA coding sequence) or both can be part of a same molecule (e.g., one vector containing coding (and regulatory) sequence for both the polynucleotide programmable nucleotide binding domain and the guide RNA).

A guide polynucleotide can comprise one or more modifications to provide a nucleic acid with a new or enhanced feature. A guide polynucleotide can comprise a nucleic acid affinity tag. A guide polynucleotide can comprise synthetic nucleotide, synthetic nucleotide analog, nucleotide derivatives, and/or modified nucleotides.

In some embodiments, a gRNA or a guide polynucleotide can comprise modifications. A modification can be made at any location of a gRNA or a guide polynucleotide. More than one modification can be made to a single gRNA or a guide polynucleotide. A gRNA or a guide polynucleotide can undergo quality control after a modification. In some embodiments, quality control can include PAGE, HPLC, MS, or any combination thereof.

A modification of a gRNA or a guide polynucleotide can be a substitution, insertion, deletion, chemical modification, physical modification, stabilization, purification, or any combination thereof.

A gRNA or a guide polynucleotide can also be modified by 5' adenylate, 5' guanosine-triphosphate cap, 5'N7-Methylguanosine-triphosphate cap, 5' triphosphate cap, 3' phosphate, 3' thiophosphate, 5' phosphate, 5' thiophosphate, Cis-Syn thymidine dimer, trimers, C12 spacer, C3 spacer, C6 spacer, dSpacer, PC spacer, rSpacer, Spacer 18, Spacer 9,3'-3' modifications, 5'-5' modifications, abasic, acridine, azobenzene, biotin, biotin BB, biotin TEG, cholesteryl TEG, desthiobiotin TEG, DNP TEG, DNP-X, DOTA, dT-Biotin, dual biotin, PC biotin, psoralen C2, psoralen C6, TINA, 3'DABCYL, black hole quencher 1, black hole quencher 2, DABCYL SE, dT-DABCYL, IRDye QC-1, QSY-21, QSY-35, QSY-7, QSY-9, carboxyl linker, thiol linkers, 2'-deoxyribonucleoside analog purine, 2'-deoxyribonucleoside analog pyrimidine, ribonucleoside analog, 2'-O-methyl ribonucleoside analog, sugar modified analogs, wobble/universal bases, fluorescent dye label, 2'-fluoro RNA, 2'-O-methyl RNA, methylphosphonate, phosphodiester DNA, phosphodiester RNA, phosphothioate DNA, phosphorothioate RNA, UNA, pseudouridine-5'-triphosphate, 5'-methylcytidine-5'-triphosphate, or any combination thereof.

In some embodiments, a modification is permanent. In other cases, a modification is transient. In some embodiments, multiple modifications are made to a gRNA or a guide polynucleotide. A gRNA or a guide polynucleotide modification can alter physiochemical properties of a nucleotide, such as their conformation, polarity, hydrophobicity, chemical reactivity, base-pairing interactions, or any combination thereof.

The PAM sequence can be any PAM sequence known in the art. Suitable PAM sequences include, but are not limited to, NGG, NGA, NGC, NGN, NGT, NGCG, NGAG, NGAN, NGNG, NGCN, NGCG, NGTN, NNGRRT, NNNRRT, NNGRR(N), TTTV, TYCV, TYCV, TATV, NNNNGATT, NNAGAAW, or NAAAAC. Y is a pyrimidine; N is any nucleotide base; W is A or T.

A modification can also be a phosphorothioate substitute. In some embodiments, a natural phosphodiester bond can be susceptible to rapid degradation by cellular nucleases and; a modification of internucleotide linkage using phosphorothioate (PS) bond substitutes can be more stable towards hydrolysis by cellular degradation. A modification can increase stability in a gRNA or a guide polynucleotide. A modification can also enhance biological activity. In some embodiments, a phosphorothioate enhanced RNA gRNA can inhibit RNase A, RNase T1, calf serum nucleases, or any combinations thereof. These properties can allow the use of PS-RNA gRNAs to be used in applications where exposure to nucleases is of high probability in vivo or in vitro. For example, phosphorothioate (PS) bonds can be introduced between the last 3-5 nucleotides at the 5'- or "-end of a gRNA which can inhibit exonuclease degradation. In some embodiments, phosphorothioate bonds can be added throughout an entire gRNA to reduce attack by endonucleases.

Protospacer Adjacent Motif

The term "protospacer adjacent motif (PAM)" or PAM-like motif refers to a 2-6 base pair DNA sequence immediately following the DNA sequence targeted by the Cas9 nuclease in the CRISPR bacterial adaptive immune system. In some embodiments, the PAM can be a 5' PAM (i.e., located upstream of the 5' end of the protospacer). In other embodiments, the PAM can be a 3' PAM (i.e., located downstream of the 5' end of the protospacer).

The PAM sequence is essential for target binding, but the exact sequence depends on a type of Cas protein.

A base editor provided herein can comprise a CRISPR protein-derived domain that is capable of binding a nucleotide sequence that contains a canonical or non-canonical protospacer adjacent motif (PAM) sequence. A PAM site is a nucleotide sequence in proximity to a target polynucleotide sequence. Some aspects of the disclosure provide for base editors comprising all or a portion of CRISPR proteins that have different PAM specificities. For example, typically Cas9 proteins, such as Cas9 from S. pyogenes (spCas9), require a canonical NGG PAM sequence to bind a particular nucleic acid region, where the "N" in "NGG" is adenine (A), thymine (T), guanine (G), or cytosine (C), and the G is guanine. A PAM can be CRISPR protein-specific and can be different between different base editors comprising different CRISPR protein-derived domains. A PAM can be 5' or 3' of a target sequence. A PAM can be upstream or downstream of a target sequence. A PAM can be 1, 2, 3, 4, 5, 6, 7, 8, 9, 10 or more nucleotides in length. Often, a PAM is between 2-6 nucleotides in length. Several PAM variants are described in Table 1 below.

TABLE 1

Cas9 proteins and corresponding PAM sequences

| Variant | PAM |
|---|---|
| spCas9 | NGG |
| spCas9-VRQR | NGA |
| spCas9-VRER | NGCG |
| xCas9 (sp) | NGN |
| saCas9 | NNGRRT |
| saCas9-KKH | NNNRRT |
| spCas9-MQKSER | NGCG |
| spCas9-MQKSER | NGCN |
| spCas9-LRKIQK | NGTN |
| spCas9-LRVSQK | NGTN |
| spCas9-LRVSQL | NGTN |
| spCas9-MQKFRAER | NGC |
| Cpf1 | 5' (TTTV) |
| SpyMac | 5'-NAA-3' |

In some embodiments, the PAM is NGC. In some embodiments, the NGC PAM is recognized by a Cas9 variant. In some embodiments, the NGC PAM variant includes one or more amino acid substitutions selected from D1135M, S1136Q, G1218K, E1219F, A1322R, D1332A, R1335E, and T1337R (collectively termed "MQKFRAER").

In some embodiments, the PAM is NGT. In some embodiments, the NGT PAM is recognized by a Cas9 variant. In some embodiments, the NGT PAM variant is generated through targeted mutations at one or more residues 1335, 1337, 1135, 1136, 1218, and/or 1219. In some embodiments, the NGT PAM variant is created through targeted mutations at one or more residues 1219, 1335, 1337, 1218. In some embodiments, the NGT PAM variant is created through targeted mutations at one or more residues 1135, 1136, 1218, 1219, and 1335. In some embodiments, the NGT PAM variant is selected from the set of targeted mutations provided in Table 2 and Table 3 below.

TABLE 2

NGT PAM Variant Mutations at residues 1219, 1335, 1337, 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |
| 9 | L | L | T | |
| 10 | L | L | R | |
| 11 | L | L | Q | |
| 12 | L | L | L | |
| 13 | F | I | T | |
| 14 | F | I | R | |
| 15 | F | I | Q | |
| 16 | F | I | L | |
| 17 | F | G | C | |
| 18 | H | L | N | |
| 19 | F | G | C | A |
| 20 | H | L | N | V |
| 21 | L | A | W | |
| 22 | L | A | F | |
| 23 | L | A | Y | |

TABLE 2-continued

NGT PAM Variant Mutations at residues 1219, 1335, 1337, 1218

| Variant | E1219V | R1335Q | T1337 | G1218 |
|---|---|---|---|---|
| 24 | I | A | W | |
| 25 | I | A | F | |
| 26 | I | A | Y | |

TABLE 3

NGT PAM Variant Mutations at residues 1135, 1136, 1218, 1219, and 1335

| Variant | D1135L | S1136R | G1218S | E1219V | R1335Q |
|---|---|---|---|---|---|
| 27 | G | | | | |
| 28 | V | | | | |
| 29 | I | | | | |
| 30 | | A | | | |
| 31 | | W | | | |
| 32 | | H | | | |
| 33 | | K | | | |
| 34 | | | K | | |
| 35 | | | R | | |
| 36 | | | Q | | |
| 37 | | | T | | |
| 38 | | | N | | |
| 39 | | | | I | |
| 40 | | | | A | |
| 41 | | | | N | |
| 42 | | | | Q | |
| 43 | | | | G | |
| 44 | | | | L | |
| 45 | | | | S | |
| 46 | | | | T | |

TABLE 3-continued

NGT PAM Variant Mutations at residues 1135, 1136, 1218, 1219, and 1335

| Variant | D1135L | S1136R | G1218S | E1219V | R1335Q |
|---|---|---|---|---|---|
| 47 | | | | | L |
| 48 | | | | | I |
| 49 | | | | | V |
| 50 | | | | | N |
| 51 | | | | | S |
| 52 | | | | | T |
| 53 | | | | | F |
| 54 | | | | | Y |
| 55 | N1286Q | I1331F | | | |

In some embodiments, the NGT PAM variant is selected from variant 5, 7, 28, 31, or 36 in Tables 2 and 3. In some embodiments, the variants have improved NGT PAM recognition.

In some embodiments, the NGT PAM variants have mutations at residues 1219, 1335, 1337, and/or 1218. In some embodiments, the NGT PAM variant is selected with mutations for improved recognition from the variants provided in Table 4 below.

TABLE 4

NGT PAM Variant Mutations at residues 1219, 1335, 1337, and 1218

| Variant | E1219V | R1335Q | T1337 | G1218 |
|---|---|---|---|---|
| 1 | F | V | T | |
| 2 | F | V | R | |
| 3 | F | V | Q | |
| 4 | F | V | L | |
| 5 | F | V | T | R |
| 6 | F | V | R | R |
| 7 | F | V | Q | R |
| 8 | F | V | L | R |

In some embodiments, base editors with specificity for NGT PAM may be generated as provided in Table 5A below.

TABLE 5A

NGT PAM variants

| | NGTN variant | D1135 | S1136 | G1218 | E1219 | A1322R | R1335 | T1337 |
|---|---|---|---|---|---|---|---|---|
| Variant 1 | LRKIQK | L | R | K | I | — | Q | K |
| Variant 2 | LRSVQK | L | R | S | V | — | Q | K |
| Variant 3 | LRSVQL | L | R | S | V | — | Q | L |
| Variant 4 | LRKIRQK | L | R | K | I | R | Q | K |
| Variant 5 | LRSVRQK | L | R | S | V | R | Q | K |
| Variant 6 | LRSVRQL | L | R | S | V | R | Q | L |

In some embodiments the NGTN variant is variant 1. In some embodiments, the NGTN variant is variant 2. In some embodiments, the NGTN variant is variant 3. In some embodiments, the NGTN variant is variant 4. In some embodiments, the NGTN variant is variant 5. In some embodiments, the NGTN variant is variant 6.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D10X mutation, or a corresponding mutation in any of the amino acid sequences provided herein, wherein X is any amino acid except for D. In some embodiments, the SpCas9 comprises a D10A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises a D9X mutation, or a corresponding mutation in any of the amino acid sequences provided herein, wherein X is any amino acid except for D. In some embodiments, the SpCas9 comprises a D9A mutation, or a corresponding mutation in any of the amino acid sequences provided herein. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having an NGG, a NGA, or a NGCG PAM sequence. In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135E, R1335Q, and T1337R mutation, or a corresponding mutation in any of the amino acid sequences provided herein. In some embodiments, the SpCas9 domain comprises a D1135E, a R1335Q, and a T1337R mutation, or corresponding mutations in any of the amino acid sequences provided herein. In some embodiments, the SpCas9 domain comprises one or more of a D1135X, a R1335X, and a T1337X mutation, or a corresponding mutation in any of the amino acid sequences provided herein, wherein X is any amino acid. In some embodiments, the SpCas9 domain comprises one or more of a D1135V, a R1335Q, and a T1337R mutation, or a corresponding mutation in any of the amino acid sequences provided herein, the SpCas9 domain comprises a D1135V, a R1335Q, and a T1337R mutation, or corresponding mutations in any of the amino acid sequences provided herein. In some embodiments, the SpCas9 domain comprises one or more of a D1135X, a G1218X, a R1335X, and a T1337X mutation, or a corresponding mutation in any of the amino acid sequences provided herein, wherein X is any amino acid. In some embodiments, the SpCas9 domain comprises one or more of a D1135V, a G1218R, a R1335Q, and a T1337R mutation, or a corresponding mutation in any of the amino acid sequences provided herein. In some embodiments, the SpCas9 domain comprises a D1135V, a G1218R, a R1335Q, and a T1337R mutation, or corresponding mutations in any of the amino acid sequences provided herein. In some embodiments, the Cas9 is a Cas9 variant having specificity for an altered PAM sequence. In some embodiments, the Additional Cas9 variants and PAM sequences are described in Miller et al., Continuous evolution of SpCas9 variants compatible with non-G PAMs. Nat Biotechnol (2020). https://doi.org/10.1038/s41587-020-4112-8, the entirety of which is incorporated herein by reference. in some embodiments, a Cas9 variate have no specific PAM requirements. In some embodiments, a Cas9 variant, e.g. a SpCas9 variant has specificity for a NRNH PAM, wherein R is A or G and H is A, C, or T. In some embodiments, the SpCas9 variant has specificity for a PAM sequence AAA, TAA, CAA, GAA, TAT, GAT, or CAC. In some embodiments, the SpCas9 variant comprises an amino acid substitution at position 1114, 1134, 1135, 1137, 1139, 1151, 1180, 1188, 1211, 1218, 1219, 1221, 1249, 1256, 1264, 1290, 1318, 1317, 1320, 1321, 1323, 1332, 1333, 1335, 1337, or 1339 as numbered in SEQ ID NO: 1 or a corresponding position thereof. In some embodiments, the SpCas9 variant comprises an amino acid substitution at position 1114, 1135, 1218, 1219, 1221, 1249, 1320, 1321, 1323, 1332, 1333, 1335, or 1337 as numbered in SEQ ID NO: 1 or a corresponding position thereof. In some embodiments, the SpCas9 variant comprises an amino acid substitution at position 1114, 1134, 1135, 1137, 1139, 1151, 1180, 1188, 1211, 1219, 1221, 1256, 1264, 1290, 1318, 1317, 1320, 1323, 1333 as numbered in SEQ ID NO: 1 or a corresponding position thereof. In some embodiments, the SpCas9 variant comprises an amino acid substitution at position 1114, 1131, 1135, 1150, 1156, 1180, 1191, 1218, 1219, 1221, 1227, 1249, 1253, 1286, 1293, 1320, 1321, 1332, 1335, 1339 as numbered in SEQ ID NO: 1 or a corresponding position thereof. In some embodiments, the SpCas9 variant comprises an amino acid substitution at position 1114, 1127, 1135, 1180, 1207, 1219, 1234, 1286, 1301, 1332, 1335, 1337, 1338, 1349 as numbered in SEQ ID NO: 1 or a corresponding position thereof. Exemplary amino acid substitutions and PAM specificity of SpCas9 variants are shown in Tables 5B, 5C, 5D, and 5E below.

TABLE 5B

| SpCas9/PAM | \multicolumn{13}{c}{SpCas9 amino acid position} |
|---|---|---|---|---|---|---|---|---|---|---|---|---|---|
| | 1114 | 1135 | 1218 | 1219 | 1221 | 1249 | 1320 | 1321 | 1323 | 1332 | 1333 | 1335 | 1337 |
| | R | D | G | E | Q | P | A | P | A | D | R | R | T |
| AAA | | N | | V | H | | | | | | G | | |
| AAA | | N | | V | H | | | | | | G | | |
| AAA | | | | V | | | | | | | G | | |
| TAA | G | N | | V | | | | | | | I | | |
| TAA | | N | | V | | | | | | | I | | A |
| TAA | G | N | | V | | | | | | | I | | A |
| CAA | | | | V | | | | | | | K | | |
| CAA | | N | | V | | | | | | | K | | |
| CAA | | N | | V | | | | | | | K | | |
| GAA | | | | V | H | | V | | | | K | | |
| GAA | | N | | V | | | V | | | | K | | |
| GAA | | | | V | H | | V | | | | K | | |
| TAT | | | S | V | H | S | | S | | | | L | |
| TAT | | | S | V | H | S | | S | | | | L | |
| TAT | | | S | V | H | S | | S | | | | L | |
| GAT | | | | V | | | | | | | I | | |
| GAT | | | | V | | | | | D | | Q | | |
| GAT | | | | V | | | | | D | | Q | | |
| CAC | | | | V | | | | | | N | | Q | N |
| CAC | | N | | V | | | | | | | | Q | N |

TABLE 5B-continued

| SpCas9/ PAM | 1114 R | 1135 D | 1218 G | 1219 E | 1221 Q | 1249 P | 1320 A | 1321 P | 1323 A | 1332 D | 1333 R | 1335 R | 1337 T |
|---|---|---|---|---|---|---|---|---|---|---|---|---|---|
| CAC | | | | V | | | | | | N | | Q | N |

TABLE 5C

| SpCas9/ PAM | 1114 R | 1134 F | 1135 D | 1137 P | 1139 V | 1151 K | 1180 D | 1188 K | 1211 K | 1219 E | 1221 Q | 1256 Q | 1264 H | 1290 V | 1318 L | 1317 N | 1320 A | 1323 A | 1333 R |
|---|---|---|---|---|---|---|---|---|---|---|---|---|---|---|---|---|---|---|---|
| GAA | | | | | | | | | | V | H | | | | | | V | | K |
| GAA | | | N | S | | | | | | V | | | | | | | V | D | K |
| GAA | | | N | | | | | | | V | H | | Y | | | | V | | K |
| CAA | | | N | | | | | | | V | H | | Y | | | | V | | K |
| CAA | G | | N | S | | | | | | V | H | | Y | | | | V | | K |
| CAA | | | N | | | | | R | | V | H | | | | | | V | | K |
| CAA | | | N | | | | | G | | R | V | H | | Y | | | | V | | K |
| CAA | | | N | | | | | G | | V | H | | Y | | | | V | | K |
| AAA | | | N | | | | | G | | V | H | R | Y | | | | V | D | K |
| CAA | G | | N | | | | | G | | V | H | | Y | | | | V | D | K |
| CAA | | L | N | | | | | G | | V | H | | Y | | | T | V | D | K |
| TAA | G | | N | | | | | G | | V | H | | Y | G | S | | V | D | K |
| TAA | G | | N | | | E | | G | | V | H | | Y | | S | | V | | K |
| TAA | G | | N | | | | | G | | V | H | | Y | | S | | V | D | K |
| TAA | G | | N | | | | | G | | R | V | H | | | | | | V | | K |
| TAA | | | N | | | | | G | | R | V | H | | Y | | | | V | | K |
| TAA | G | | N | | A | | | G | | V | H | | | | | | V | | K |
| TAA | G | | N | | | | | | | V | H | | | | | | V | | K |

TABLE 5D

| SpCas9/ PAM | 1114 R | 1131 Y | 1135 D | 1150 E | 1156 K | 1180 D | 1191 K | 1218 G | 1219 E | 1221 Q |
|---|---|---|---|---|---|---|---|---|---|---|
| SacB.TAT | | | N | | | | N | | V | H |
| SacB.TAT | | | N | | | | | S | V | H |
| AAT | | | N | | | | | S | V | H |
| TAT | G | | N | | | G | | S | V | H |
| TAT | G | | N | | | G | | S | V | H |
| TAT | G | C | N | | | G | | S | V | H |
| TAT | G | C | N | | | G | | S | V | H |
| TAT | G | C | N | | | G | | S | V | H |
| TAT | G | C | N | | E | G | | S | V | H |
| TAT | G | C | N | V | | G | | S | V | H |
| TAT | | | C | N | | | G | | S | V | H |
| TAT | G | C | N | | | G | | S | V | H |

| SpCas9/ PAM | 1227 A | 1249 P | 1253 E | 1286 N | 1293 A | 1320 A | 1321 P | 1332 D | 1335 R | 1339 T |
|---|---|---|---|---|---|---|---|---|---|---|
| SacB.TAT | | | | | | V | S | | L | |
| SacB.TAT | | S | | | | | S | G | L | |
| AAT | V | S | | K | T | | S | G | L | I |
| TAT | | S | K | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |
| TAT | | S | | | | | S | G | L | |

TABLE 5E

| SpCas9/PAM | 1114 R | 1127 D | 1135 D | 1180 D | 1207 E | 1219 E | 1234 N | 1286 N | 1301 P | 1332 D | 1335 R | 1337 T | 1338 S | 1349 H |
|---|---|---|---|---|---|---|---|---|---|---|---|---|---|---|
| SacB.CAC |   |   | N |   |   | V |   |   |   | N | Q | N |   |   |
| AAC | G |   | N |   |   | V |   |   |   | N | Q | N |   |   |
| AAC | G |   | N |   |   | V |   |   |   | N | Q | N |   |   |
| TAC | G |   | N |   |   | V |   |   |   | N | Q | N |   |   |
| TAC | G |   | N |   |   | V |   |   | H | N | Q | N |   |   |
| TAC | G |   | N |   | G | V |   | D | H | N | Q | N |   |   |
| TAC | G |   | N |   |   | V |   |   |   | N | Q | N |   |   |
| TAC | G | G | N | E |   | V |   |   | H | N | Q | N |   |   |
| TAC | G |   | N |   |   | V |   |   | H | N | Q | N |   |   |
| TAC | G |   | N |   |   | V |   |   |   | N | Q | N | T | R |

In some embodiments, the Cas9 domains of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to a Cas9 polypeptide described herein. In some embodiments, the Cas9 domains of any of the fusion proteins provided herein comprises the amino acid sequence of any Cas9 polypeptide described herein. In some embodiments, the Cas9 domains of any of the fusion proteins provided herein consists of the amino acid sequence of any Cas9 polypeptide described herein.

In some examples, a PAM recognized by a CRISPR protein-derived domain of a base editor disclosed herein can be provided to a cell on a separate oligonucleotide to an insert (e.g., an AAV insert) encoding the base editor. In such embodiments, providing PAM on a separate oligonucleotide can allow cleavage of a target sequence that otherwise would not be able to be cleaved, because no adjacent PAM is present on the same polynucleotide as the target sequence.

In an embodiment, S. pyogenes Cas9 (SpCas9) can be used as a CRISPR endonuclease for genome engineering. However, others can be used. In some embodiments, a different endonuclease can be used to target certain genomic targets. In some embodiments, synthetic SpCas9-derived variants with non-NGG PAM sequences can be used. Additionally, other Cas9 orthologues from various species have been identified and these "non-SpCas9s" can bind a variety of PAM sequences that can also be useful for the present disclosure. For example, the relatively large size of SpCas9 (approximately 4 kb coding sequence) can lead to plasmids carrying the SpCas9 cDNA that cannot be efficiently expressed in a cell. Conversely, the coding sequence for Staphylococcus aureus Cas9 (SaCas9) is approximately 1 kilobase shorter than SpCas9, possibly allowing it to be efficiently expressed in a cell. Similar to SpCas9, the SaCas9 endonuclease is capable of modifying target genes in mammalian cells in vitro and in mice in vivo. In some embodiments, a Cas protein can target a different PAM sequence. In some embodiments, a target gene can be adjacent to a Cas9 PAM, 5'-NGG, for example. In other embodiments, other Cas9 orthologs can have different PAM requirements. For example, other PAMs such as those of S. thermophilus (5'-NNAGAA for CRISPR1 and 5'-NGGNG for CRISPR3) and Neisseria meningitidis (5'-NNNNGATT) can also be found adjacent to a target gene.

In some embodiments, for a S. pyogenes system, a target gene sequence can precede (i.e., be 5' to) a 5'-NGG PAM, and a 20-nt guide RNA sequence can base pair with an opposite strand to mediate a Cas9 cleavage adjacent to a PAM. In some embodiments, an adjacent cut can be or can be about 3 base pairs upstream of a PAM. In some embodiments, an adjacent cut can be or can be about 10 base pairs upstream of a PAM. In some embodiments, an adjacent cut can be or can be about 0-20 base pairs upstream of a PAM. For example, an adjacent cut can be next to, 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 base pairs upstream of a PAM. An adjacent cut can also be downstream of a PAM by 1 to 30 base pairs. The sequences of exemplary SpCas9 proteins capable of binding a PAM sequence follow:

The amino acid sequence of an exemplary PAM-binding SpCas9 is as follows:

(SEQ ID NO: 1)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

```
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD
```

The amino acid sequence of an exemplary PAM-binding SpCas9n is as follows:

```
(SEQ ID NO: 31)
MDKKYSIGLAIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMIKRYDEHHQDLTLLKALVRQQLPEKYKEI
FFDQSKNGYAGYIDGGASQEEFYKFIKPILEKMDG
TEELLVKLNREDLLRKQRTFDNGSIPHQIHLGELH
AILRRQEDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRRRYTGWGRLSRK
LINGIRDKQSGKTILDFLKSDGFANRNFMQLIHDD
SLTFKEDIQKAQVSGQGDSLHEHIANLAGSPAIKK
GILQTVKVVDELVKVMGRHKPENIVIEMARENQTT
QKGQKNSRERMKRIEEGIKELGSQILKEHPVENTQ
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERGGLSE
LDKAGFIKRQLVETRQITKHVAQILDSRMNTKYDE
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
VLSMPQVNIVKKTEVQTGGFSKESILPKRNSDKLI
ARKKDWDPKKYGGFDSPTVAYSVLVVAKVEKGKSK
KLKSVKELLGITIMERSSFEKNPIDFLEAKGYKEV
KKDLIIKLPKYSLFELENGRKRMLASAGELQKGNE
LALPSKYVNFLYLASHYEKLKGSPEDNEQKQLFVE
QHKHYLDEIIEQISEFSKRVILADANLDKVLSAYN
KHRDKPIREQAENIIHLFTLTNLGAPAAFKYFDTT
IDRKRYTSTKEVLDATLIHQSITGLYETRIDLSQL
GGD
```

The amino acid sequence of an exemplary PAM-binding SpEQR Cas9 is as follows:

```
(SEQ ID NO: 93)
MDKKYSIGLAIGTNSVGWAVITDEYKVPSKKFKVL
GNTDRHSIKKNLIGALLFDSGETAEATRLKRTARR
RYTRRKNRICYLQEIFSNEMAKVDDSFFHRLEESV
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMIKRYDEHHQDLTLLKALVRQQLPEKYKEI
FFDQSKNGYAGYIDGGASQEEFYKFIKPILEKMDG
TEELLVKLNREDLLRKQRTFDNGSIPHQIHLGELH
AILRRQEDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRRRYTGWGRLSRK
LINGIRDKQSGKTILDFLKSDGFANRNFMQLIHDD
SLTFKEDIQKAQVSGQGDSLHEHIANLAGSPAIKK
GILQTVKVVDELVKVMGRHKPENIVIEMARENQTT
QKGQKNSRERMKRIEEGIKELGSQILKEHPVENTQ
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERGGLSE
LDKAGFIKRQLVETRQITKHVAQILDSRMNTKYDE
```

-continued
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
VLSMPQVNIVKKTEVQTGGFSKESILPKRNSDKLI
ARKKDWDPKKYGGFESPTVAYSVLVVAKVEKGKSK
KLKSVKELLGITIMERSSFEKNPIDFLEAKGYKEV
KKDLIIKLPKYSLFELENGRKRMLASAGELQKGNE
LALPSKYVNFLYLASHYEKLKGSPEDNEQKQLFVE
QHKHYLDEIIEQISEFSKRVILADANLDKVLSAYN
KHRDKPIREQAENIIHLFTLTNLGAPAAFKYFDTT
IDRKQYRSTKEVLDATLIHQSITGLYETRIDLSQL
GGD In the above sequence, residues E1134, Q1334, and R1336, which can be mutated from D1134, R1335, and T1336 to yield a SpEQR Cas9, are underlined and in bold.

The amino acid sequence of an exemplary PAM-binding SpVQR Cas9 is as follows:

(SEQ ID NO: 94)
MDKKYSIGLAIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMIKRYDEHHQDLTLLKALVRQQLPEKYKEI
FFDQSKNGYAGYIDGGASQEEFYKFIKPILEKMDG
TEELLVKLNREDLLRKQRTFDNGSIPHQIHLGELH
AILRRQEDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE
MIEERLKTYAHLFDDKVMKQLKRRRYTGWGRLSRK
LINGIRDKQSGKTILDFLKSDGFANRNFMQLIHDD
SLTFKEDIQKAQVSGQGDSLHEHIANLAGSPAIKK
GILQTVKVVDELVKVMGRHKPENIVIEMARENQTT
QKGQKNSRERMKRIEEGIKELGSQILKEHPVENTQ

-continued
LQNEKLYLYYLQNGRDMYVDQELDINRLSDYDVDH
IVPQSFLKDDSIDNKVLTRSDKNRGKSDNVPSEEV
VKKMKNYWRQLLNAKLITQRKFDNLTKAERGGLSE
LDKAGFIKRQLVETRQITKHVAQILDSRMNTKYDE
NDKLIREVKVITLKSKLVSDFRKDFQFYKVREINN
YHHAHDAYLNAVVGTALIKKYPKLESEFVYGDYKV
YDVRKMIAKSEQEIGKATAKYFFYSNIMNFFKTEI
TLANGEIRKRPLIETNGETGEIVWDKGRDFATVRK
VLSMPQVNIVKKTEVQTGGFSKESILPKRNSDKLI
ARKKDWDPKKYGGFVSPTVAYSVLVVAKVEKGKSK
KLKSVKELLGITIMERSSFEKNPIDFLEAKGYKEV
KKDLIIKLPKYSLFELENGRKRMLASAGELQKGNE
LALPSKYVNFLYLASHYEKLKGSPEDNEQKQLFVE
QHKHYLDEIIEQISEFSKRVILADANLDKVLSAYN
KHRDKPIREQAENIIHLFTLTNLGAPAAFKYFDTT
IDRKQYRSTKEVLDATLIHQSITGLYETRIDLSQL
GGD In the above sequence, residues V1134, Q1334, and R1336, which can be mutated from D1134, R1335, and T1336 to yield a SpVQR Cas9, are underlined and in bold.

The amino acid sequence of an exemplary PAM-binding SpVRER Cas9 is as follows:

(SEQ ID NO: 95)
MDKKYSIGLAIGTNSVGWAVITDEYKVPSKKFKVL
GNTDRHSIKKNLIGALLFDSGETAEATRLKRTARR
RYTRRKNRICYLQEIFSNEMAKVDDSFFHRLEESF
LVEEDKKHERHPIFGNIVDEVAYHEKYPTIYHLRK
KLVDSTDKADLRLIYLALAHMIKFRGHFLIEGDLN
PDNSDVDKLFIQLVQTYNQLFEENPINASGVDAKA
ILSARLSKSRRLENLIAQLPGEKKNGLFGNLIALS
LGLTPNFKSNFDLAEDAKLQLSKDTYDDDLDNLLA
QIGDQYADLFLAAKNLSDAILLSDILRVNTEITKA
PLSASMIKRYDEHHQDLTLLKALVRQQLPEKYKEI
FFDQSKNGYAGYIDGGASQEEFYKFIKPILEKMDG
TEELLVKLNREDLLRKQRTFDNGSIPHQIHLGELH
AILRRQEDFYPFLKDNREKIEKILTFRIPYYVGPL
ARGNSRFAWMTRKSEETITPWNFEEVVDKGASAQS
FIERMTNFDKNLPNEKVLPKHSLLYEYFTVYNELT
KVKYVTEGMRKPAFLSGEQKKAIVDLLFKTNRKVT
VKQLKEDYFKKIECFDSVEISGVEDRFNASLGTYH
DLLKIIKDKDFLDNEENEDILEDIVLTLTLFEDRE

-continued

```
MIEERLKTYAHLFDDKVMKQLKRRRYTGWGRLSRK

LINGIRDKQSGKTILDFLKSDGFANRNFMQLIHDD

SLTFKEDIQKAQVSGQGDSLHEHIANLAGSPAIKK

GILQTVKVVDELVKVMGRHKPENIVIEMARENQTT

QKGQKNSRERMKRIEEGIKELGSQILKEHPVENTQ

LQNEKLYLYYLQNGRDMYVDQELDINRLSDYDVDH

IVPQSFLKDDSIDNKVLTRSDKNRGKSDNVPSEEV

VKKMKNYWRQLLNAKLITQRKFDNLTKAERGGLSE

LDKAGFIKRQLVETRQITKHVAQILDSRMNTKYDE

NDKLIREVKVITLKSKLVSDFRKDFQFYKVREINN

YHHAHDAYLNAVVGTALIKKYPKLESEFVYGDYKV

YDVRKMIAKSEQEIGKATAKYFFYSNIMNFFKTEI

TLANGEIRKRPLIETNGETGEIVWDKGRDFATVRK

VLSMPQVNIVKKTEVQTGGFSKESILPKRNSDKLI

ARKKDWDPKKYGGFVSPTVAYSVLVVAKVEKGKSK

KLKSVKELLGITIMERSSFEKNPIDFLEAKGYKEV

KKDLIIKLPKYSLFELENGRKRMLASARELQKGNE

LALPSKYVNFLYLASHYEKLKGSPEDNEQKQLFVE

QHKHYLDEIIEQISEFSKRVILADANLDKVLSAYN

KHRDKPIREQAENIIHLFTLTNLGAPAAFKYFDTT

IDRKEYRSTKEVLDATLIHQSITGLYETRIDLSQL

GGD.
```

In the above sequence, residues V1134, R1217, Q1334, and R1336, which can be mutated from D1134, G1217, R1335, and T1336 to yield a SpVRER Cas9, are underlined and in bold.

In some embodiments, engineered SpCas9 variants are capable of recognizing protospacer adjacent motif (PAM) sequences flanked by a 3' H (non-G PAM) (see Tables A-D and FIG. 49). In some embodiments, the SpCas9 variants recognize NRNH PAMs (where R is A or G and H is A, C or T). In some embodiments, the non-G PAM is NRRH, NRTH, or NRCH. These variants were evolved through phage-assisted non-continuous evolution (PANCE), e.g., as described in Miller, S. M., et al. Continuous evolution of SpCas9 variants compatible with non-G PAMs, Nat. Biotechnol. (2020), (//doi.org/10.1038/s41587-020-0412-8), the contents of which are incorporated herein by reference in their entirety.

In some embodiments, the Cas9 domain is a recombinant Cas9 domain. In some embodiments, the recombinant Cas9 domain is a SpyMacCas9 domain. In some embodiments, the SpyMacCas9 domain is a nuclease active SpyMacCas9, a nuclease inactive SpyMacCas9 (SpyMacCas9d), or a SpyMacCas9 nickase (SpyMacCas9n). In some embodiments, the SaCas9 domain, the SaCas9d domain, or the SaCas9n domain can bind to a nucleic acid sequence having a non-canonical PAM. In some embodiments, the SpyMacCas9 domain, the SpCas9d domain, or the SpCas9n domain can bind to a nucleic acid sequence having a NAA PAM sequence.

The sequence of an exemplary Cas9 A homolog of Spy Cas9 in *Streptococcus macacae* with native 5'-NAAN-3' PAM specificity is known in the art and described, for example, by Jakimo et al., (www.biorxiv.org/content/biorxiv/early/2018/09/27/429654.full.pdf), and is provided below.

SpyMacCas9
(SEQ ID NO: 96)
```
MDKKYSIGLDIGTNSVGWAVITDDYKVPSK

KFKVLGNTDRHSIKKNLIGALLFGSGETAE

ATRLKRTARRRYTRRKNRICYLQEIFSNEM

AKVDDSFFHRLEESFLVEEDKKHERHPIFG

NIVDEVAYHEKYPTIYHLRKKLADSTDKAD

LRLIYLALAHMIKFRGHFLIEGDLNPDNSD

VDKLFIQLVQIYNQLFEENPINASRVDAKA

ILSARLSKSRRLENLIAQLPGEKRNGLFGN

LIALSLGLTPNFKSNFDLAEDAKLQLSKDT

YDDDLDNLLAQIGDQYADLFLAAKNLSDAI

LLSDILRVNSEITKAPLSASMIKRYDEHHQ

DLTLLKALVRQQLPEKYKEIFFDQSKNGYA

GYIDGGASQEEFYKFIKPILEKMDGTEELL

VKLNREDLLRKQRTFDNGSIPHQIHLGELH

AILRRQEDFYPFLKDNREKIEKILTFRIPY

YVGPLARGNSRFAWMTRKSEETITPWNFEE

VVDKGASAQSFIERMTNFDKNLPNEKVLPK

HSLLYEYFTVYNELTKVKYVTEGMRKPAFL

SGEQKKAIVDLLFKTNRKVTVKQLKEDYFK

KIECFDSVEISGVEDRFNASLGAYHDLLKI

IKDKDFLDNEENEDILEDIVLTLTLFEDRG

MIEERLKTYAHLFDDKVMKQLKRRRYTGWG

RLSRKLINGIRDKQSGKTILDFLKSDGFAN

RNFMQLIHDDSLTFKEDIQKAQVSGQHSL

HEQIANLAGSPAIKKGILQTVKIVDELVKV

MGHKPENIVIEMARENQTTQKGQKNSRERM

KRIEEGIKELGSQILKEHPVENTQLQNEKL

YLYYLQNGRDMYVDQELDINRLSDYDVDHI

VPQSFIKDDSIDNKVLTRSDKNRGKSDNVP

SEEVVKKMKNYWRQLLNAKLITQRKFDNLT

KAERGGLSELDKAGFIKRQLVETRQITKHV

AQILDSRMNTKYDENDKLIREVKVITLKSK

LVSDFRKDFQFYKVREINNYHHAHDAYLNA

VVGTALIKKYPKLESEFVYGDYKVYDVRKM

IAKSEQEIGKATAKYFFYSNIMNFFKTEIT

LANGEIRKRPLIETNGETGEIVWDKGRDFA

TVRKVLSMPQVNIVKKTEIQTVGQNGGLFD
```

```
DNPKSPLEVTPSKLVPLKKELNPKKYGGYQ

KPTTAYPVLLITDTKQLIPISVMNKKQFEQ

NPVKFLRDRGYQQVGKNDFIKLPKYTLVDI

GDGIKRLWASSKEIHKGNQLVVSKKSQILL

YHAHHLDSDLSNDYLQNHNQQFDVLFNEII

SFSKKCKLGKEHIQKIENVYSNKKNSASIE

ELAESFIKLLGFTQLGATSPFNFLGVKLNQ

KQYKGKKDYILPCTEGTLIRQSITGLYETR

VDLSKIGED.
```

In some embodiments, a variant Cas9 protein harbors, H840A, P475A, W476A, N477A, D1125A, W1126A, and D1218A mutations such that the polypeptide has a reduced ability to cleave a target DNA or RNA. Such a Cas9 protein has a reduced ability to cleave a target DNA (e.g., a single stranded target DNA) but retains the ability to bind a target DNA (e.g., a single stranded target DNA). As another non-limiting example, in some embodiments, the variant Cas9 protein harbors D10A, H840A, P475A, W476A, N477A, D1125A, W1126A, and D1218A mutations such that the polypeptide has a reduced ability to cleave a target DNA. Such a Cas9 protein has a reduced ability to cleave a target DNA (e.g., a single stranded target DNA) but retains the ability to bind a target DNA (e.g., a single stranded target DNA). In some embodiments, when a variant Cas9 protein harbors W476A and W1126A mutations or when the variant Cas9 protein harbors P475A, W476A, N477A, D1125A, W1126A, and D1218A mutations, the variant Cas9 protein does not bind efficiently to a PAM sequence. Thus, in some such cases, when such a variant Cas9 protein is used in a method of binding, the method does not require a PAM sequence. In other words, in some embodiments, when such a variant Cas9 protein is used in a method of binding, the method can include a guide RNA, but the method can be performed in the absence of a PAM sequence (and the specificity of binding is therefore provided by the targeting segment of the guide RNA). Other residues can be mutated to achieve the above effects (i.e., inactivate one or the other nuclease portions). As non-limiting examples, residues D10, G12, G17, E762, H840, N854, N863, H982, H983, A984, D986, and/or A987 can be altered (i.e., substituted). Also, mutations other than alanine substitutions are suitable.

In some embodiments, a CRISPR protein-derived domain of a base editor can comprise all or a portion of a Cas9 protein with a canonical PAM sequence (NGG). In other embodiments, a Cas9-derived domain of a base editor can employ a non-canonical PAM sequence. Such sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of Staphylococcus aureus CRISPR-Cas9 by modifying PAM recognition" Nature Biotechnology 33, 1293-1298 (2015); the entire contents of each are hereby incorporated by reference.

Cas9 Domains with Reduced PAM Exclusivity

Typically, Cas9 proteins, such as Cas9 from S. pyogenes (spCas9), require a canonical NGG PAM sequence to bind a particular nucleic acid region, where the "N" in "NGG" is adenosine (A), thymidine (T), or cytosine (C), and the G is guanosine. This may limit the ability to edit desired bases within a genome. In some embodiments, the base editing fusion proteins provided herein may need to be placed at a precise location, for example a region comprising a target base that is upstream of the PAM. See e.g., Komor, A. C., et al., "Programmable editing of a target base in genomic DNA without double-stranded DNA cleavage" Nature 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of Staphylococcus aureus CRISPR-Cas9 by modifying PAM recognition" Nature Biotechnology 33, 1293-1298 (2015); the entire contents of each are hereby incorporated by reference.

High Fidelity Cas9 Domains

Some aspects of the disclosure provide high fidelity Cas9 domains. In some embodiments, high fidelity Cas9 domains are engineered Cas9 domains comprising one or more mutations that decrease electrostatic interactions between the Cas9 domain and a sugar-phosphate backbone of a DNA, as compared to a corresponding wild-type Cas9 domain. Without wishing to be bound by any particular theory, high fidelity Cas9 domains that have decreased electrostatic interactions with a sugar-phosphate backbone of DNA may have less off-target effects. In some embodiments, a Cas9 domain (e.g., a wild-type Cas9 domain) comprises one or more mutations that decreases the association between the Cas9 domain and a sugar-phosphate backbone of a DNA. In some embodiments, a Cas9 domain comprises one or more mutations that decreases the association between the Cas9 domain and a sugar-phosphate backbone of a DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, or at least 70%.

In some embodiments, any of the Cas9 fusion proteins provided herein comprise one or more of a N497X, a R661X, a Q695X, and/or a Q926X mutation, or a corresponding mutation in any of the amino acid sequences provided herein, wherein X is any amino acid. In some embodiments, any of the Cas9 fusion proteins provided herein comprise one or more of a N497A, a R661A, a Q695A, and/or a Q926A mutation, or a corresponding mutation in any of the amino acid sequences provided herein. In some embodiments, the Cas9 domain comprises a D10A mutation, or a corresponding mutation in any of the amino acid sequences provided herein. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." Nature 529, 490-495 (2016); and Slaymaker, I. M., et al. "Rationally engineered Cas9 nucleases with improved specificity." Science 351, 84-88 (2015); the entire contents of each are incorporated herein by reference.

In some embodiments, the modified Cas9 is a high fidelity Cas9 enzyme. In some embodiments, the high fidelity Cas9 enzyme is SpCas9(K855A), eSpCas9(1.1), SpCas9-HF1, or hyper accurate Cas9 variant (HypaCas9). The modified Cas9 eSpCas9(1.1) contains alanine substitutions that weaken the interactions between the HNH/RuvC groove and the non-target DNA strand, preventing strand separation and cutting at off-target sites. Similarly, SpCas9-HF1 lowers off-target editing through alanine substitutions that disrupt Cas9's interactions with the DNA phosphate backbone. HypaCas9 contains mutations (SpCas9 N692A/M694A/Q695A/H698A) in the REC3 domain that increase Cas9 proofreading and target discrimination. All three high fidelity enzymes generate less off-target editing than wildtype Cas9. An exemplary high fidelity Cas9 is provided below.

High Fidelity Cas9 domain mutations relative to Cas9 are shown in bold and underlined:

(SEQ ID NO: 97)
DKKYSIGLAIGTNSVGWAVITDEYKVPSKKFKVLG

NTDRHSIKKNLIGALLFDSGETAEATRLKRTARRR

YTRRKNRICYLQEIFSNEMAKVDDSFFHRLEESFL

VEEDKKHERHPIFGNIVDEVAYHEKYPTIYHLRKK

LVDSTDKADLRLIYLALAHMIKFRGHFLIEGDLNP

DNSDVDKLFIQLVQTYNQLFEENPINASGVDAKAI

LSARLSKSRRLENLIAQLPGEKKNGLFGNLIALSL

GLTPNFKSNFDLAEDAKLQLSKDTYDDDLDNLLAQ

IGDQYADLFLAAKNLSDAILLSDILRVNTEITKAP

LSASMIKRYDEHHQDLTLLKALVRQQLPEKYKEIF

FDQSKNGYAGYIDGGASQEEFYKFIKPILEKMDGT

EELLVKLNREDLLRKQRTFDNGSIPHQIHLGELHA

ILRRQEDFYPFLKDNREKIEKILTFRIPYYVGPLA

RGNSRFAWMTRKSEETITPWNFEEVVDKGASAQSF

IERMTAFDKNLPNEKVLPKHSLLYEYFTVYNELTK

VKYVTEGMRKPAFLSGEQKKAIVDLLFKTNRKVTV

KQLKEDYFKKIECFDSVEISGVEDRFNASLGTYHD

LLKIIKDKDFLDNEENEDILEDIVLTLTLFEDREM

IEERLKTYAHLFDDKVMKQLKRRRYTGWGALSRKL

INGIRDKQSGKTILDFLKSDGFANRNFMALIHDDS

LTFKEDIQKAQVSGQGDSLHEHIANLAGSPAIKKG

ILQTVKVVDELVKVMGRHKPENIVIEMARENQTTQ

KGQKNSRERMKRIEEGIKELGSQILKEHPVENTQL

QNEKLYLYYLQNGRDMYVDQELDINRLSDYDVDHI

VPQSFLKDDSIDNKVLTRSDKNRGKSDNVPSEEVV

KKMKNYWRQLLNAKLITQRKFDNLTKAERGGLSEL

DKAGFIKRQLVETRAITKHVAQILDSRMNTKYDEN

DKLIREVKVITLKSKLVSDFRKDFQFYKVREINNY

HHAHDAYLNAVVGTALIKKYPKLESEFVYGDYKVY

DVRKMIAKSEQEIGKATAKYFFYSNIMNFFKTEIT

LANGEIRKRPLIETNGETGEIVWDKGRDFATVRKV

LSMPQVNIVKKTEVQTGGFSKESILPKRNSDKLIA

RKKDWDPKKYGGFDSPTVAYSVLVVAKVEKGKSKK

LKSVKELLGITIMERSSFEKNPIDFLEAKGYKEVK

KDLIIKLPKYSLFELENGRKRMLASAGELQKGNEL

ALPSKYVNFLYLASHYEKLKGSPEDNEQKQLFVEQ

HKHYLDEIIEQISEFSKRVILADANLDKVLSAYNK

HRDKPIREQAENIIHLFTLTNLGAPAAFKYFDTTI

DRKRYTSTKEVLDATLIHQSITGLYETRIDLSQLG

GD

Fusion Proteins Comprising a Nuclear Localization Sequence (NLS)

In some embodiments, the fusion proteins provided herein further comprise one or more (e.g., 2, 3, 4, 5) nuclear targeting sequences, for example a nuclear localization sequence (NLS). In one embodiment, a bipartite NLS is used. In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the Cas9 domain. In some embodiments, the NLS is fused to the C-terminus of an nCas9 domain or a dCas9 domain. In some embodiments, the NLS is fused to the N-terminus of the deaminase. In some embodiments, the NLS is fused to the C-terminus of the deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, an NLS comprises the amino acid sequence PKKKRKVEGADKRTADGSEFESPKKKRKV (SEQ ID NO: 98), KRTADGSEFESPKKKRKV (SEQ ID NO: 68), KRPAATKKAGQAKKKK (SEQ ID NO: 69), KKTELQTTNAENKTKKL (SEQ ID NO: 70), KRGINDRNFWRGENGRKTR (SEQ ID NO: 71), RKSGKIAAIVVKRPRKPKKKRKV (SEQ ID NO: 99), or MDSLLMNRRKFLYQFKNVRWAKGRRETYLC (SEQ ID NO: 74).

In some embodiments, the NLS is present in a linker or the NLS is flanked by linkers, for example, the linkers described herein. In some embodiments, the N-terminus or C-terminus NLS is a bipartite NLS. A bipartite NLS comprises two basic amino acid clusters, which are separated by a relatively short spacer sequence (hence bipartite—2 parts, while monopartite NLSs are not). The NLS of nucleoplasmin, KR[PAATKKAGQA]KKKK (SEQ ID NO: 100), is the prototype of the ubiquitous bipartite signal: two clusters of basic amino acids, separated by a spacer of about 10 amino acids. The sequence of an exemplary bipartite NLS follows: PKKKRKVEGADKRTADGSEFESPKKKRKV (SEQ ID NO: 98)

In some embodiments, the fusion proteins of the invention do not comprise a linker sequence. In some embodiments, linker sequences between one or more of the domains or proteins are present.

It should be appreciated that the fusion proteins of the present disclosure may comprise one or more additional features. For example, in some embodiments, the fusion protein may comprise inhibitors, cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

A vector that encodes a CRISPR enzyme comprising one or more nuclear localization sequences (NLSs) can be used. For example, there can be or be about 1, 2, 3, 4, 5, 6, 7, 8, 9, 10 NLSs used. A CRISPR enzyme can comprise the NLSs at or near the ammo-terminus, about or more than about 1, 2, 3, 4, 5, 6, 7, 8, 9, 10 NLSs at or near the carboxy-terminus, or any combination of these (e.g., one or more NLS at the ammo-terminus and one or more NLS at the carboxy terminus). When more than one NLS is present, each can be selected independently of others, such that a single NLS can be present in more than one copy and/or in combination with one or more other NLSs present in one or more copies.

CRISPR enzymes used in the methods can comprise about 6 NLSs. An NLS is considered near the N- or C-terminus when the nearest amino acid to the NLS is within about 50 amino acids along a polypeptide chain from the N- or C-terminus, e.g., within 1, 2, 3, 4, 5, 10, 15, 20, 25, 30, 40, or 50 amino acids.

Nucleobase Editing Domain

Described herein are base editors comprising a fusion protein that includes a polynucleotide programmable nucleotide binding domain and a nucleobase editing domain (e.g., a deaminase domain). The base editor can be programmed to edit one or more bases in a target polynucleotide sequence by interacting with a guide polynucleotide capable of recognizing the target sequence. Once the target sequence has been recognized, the base editor is anchored on the polynucleotide where editing is to occur, and the deaminase domain components of the base editor can then edit a target base.

In some embodiments, the nucleobase editing domain includes a deaminase domain. As particularly described herein, the deaminase domain includes an adenosine deaminase. In some embodiments, the terms "adenine deaminase" and "adenosine deaminase" can be used interchangeably. Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A to G Editing

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein can comprise a Cas9 domain that has reduced nuclease activity. In some embodiments, the fusion proteins provided herein can have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, an A-to-G base editor further comprises an inhibitor of inosine base excision repair, for example, a uracil glycosylase inhibitor (UGI) domain or a catalytically inactive inosine specific nuclease. Without wishing to be bound by any particular theory, the UGI domain or catalytically inactive inosine specific nuclease can inhibit or prevent base excision repair of a deaminated adenosine residue (e.g., inosine), which can improve the activity or efficiency of the base editor.

A base editor comprising an adenosine deaminase can act on any polynucleotide, including DNA, RNA and DNA-RNA hybrids. In certain embodiments, a base editor comprising an adenosine deaminase can deaminate a target A of a polynucleotide comprising RNA. For example, the base editor can comprise an adenosine deaminase domain capable of deaminating a target A of an RNA polynucleotide and/or a DNA-RNA hybrid polynucleotide. In an embodiment, an adenosine deaminase incorporated into a base editor comprises all or a portion of adenosine deaminase acting on RNA (ADAR, e.g., ADAR1 or ADAR2). In another embodiment, an adenosine deaminase incorporated into a base editor comprises all or a portion of adenosine deaminase acting on tRNA (ADAT). A base editor comprising an adenosine deaminase domain can also be capable of deaminating an A nucleobase of a DNA polynucleotide. In an embodiment an adenosine deaminase domain of a base editor comprises all or a portion of an ADAT comprising one or more mutations which permit the ADAT to deaminate a target A in DNA. For example, the base editor can comprise all or a portion of an ADAT from *Escherichia coli* (EcTadA) comprising one or more of the following mutations: D108N, A106V, D147Y, E155V, L84F, H123Y, I156F, or a corresponding mutation in another adenosine deaminase.

The adenosine deaminase can be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). The corresponding residue in any homologous protein can be identified by e.g., sequence alignment and determination of homologous residues. The mutations in any naturally-occurring adenosine deaminase (e.g., having homology to ecTadA) that corresponds to any of the mutations described herein (e.g., any of the mutations identified in ecTadA) can be generated accordingly.

Adenosine Deaminases

In some embodiments, a base editor described herein can comprise a deaminase domain which includes an adenosine deaminase. Such an adenosine deaminase domain of a base editor can facilitate the editing of an adenine (A) nucleobase to a guanine (G) nucleobase by deaminating the A to form inosine (I), which exhibits base pairing properties of G. Adenosine deaminase is capable of deaminating (i.e., removing an amine group) adenine of a deoxyadenosine residue in deoxyribonucleic acid (DNA).

In some embodiments, the adenosine deaminases provided herein are capable of deaminating adenine. In some embodiments, the adenosine deaminases provided herein are capable of deaminating adenine in a deoxyadenosine residue of DNA. In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

The invention provides adenosine deaminase variants that have increased efficiency (>50-60%) and specificity. In particular, the adenosine deaminase variants described herein are more likely to edit a desired base within a polynucleotide and are less likely to edit bases that are not intended to be altered (i.e., "bystanders").

In particular embodiments, the TadA is any one of the TadA described in PCT/US2017/045381 (WO 2018/027078), which is incorporated herein by reference in its entirety.

In some embodiments, the nucleobase editors of the invention are adenosine deaminase variants comprising an alteration in the following sequence:

```
                                         (SEQ ID NO: 2)
MSEVEFSHEYWMRHALTLAKRARDEREVPVGAVLVLNNRVIGEGWNRAI

GLHDPTAHAEIMALRQGGLVMQNYRLIDATLYVTFEPCVMCAGAMIHSR

IGRVVFGVRNAKTGAAGSLMDVLHYPGMNHRVEITEGILADECAALLCY

FFRMPRQVFNAQKKAQSSTD (also termed TadA*7.10).
```

In particular embodiments, the fusion proteins comprise a single (e.g., provided as a monomer) TadA*8 variant. In some embodiments, the TadA*8 is linked to a Cas9 nickase. In some embodiments, the fusion proteins of the invention comprise as a heterodimer of a wild-type TadA (TadA(wt)) linked to a TadA*8 variant. In other embodiments, the fusion proteins of the invention comprise as a heterodimer of a TadA*7.10 linked to a TadA*8 variant. In some embodiments, the base editor is ABE8 comprising a TadA*8 variant monomer. In some embodiments, the base editor is ABE8 comprising a heterodimer of a TadA*8 variant and a TadA (wt). In some embodiments, the base editor is ABE8 comprising a heterodimer of a TadA*8 variant and TadA*7.10. In some embodiments, the base editor is ABE8 comprising a heterodimer of a TadA*8 variant. In some embodiments, the TadA*8 variant is selected from Table 7. In some embodiments, the ABE8 is selected from Table 7. The relevant sequences follow:

```
Wild-type TadA (TadA(wt)) or "the TadA reference
sequence"
                                       (SEQ ID NO: 101)
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIHSR

IGRVVFGARDAKTGAAGSLMDVLHHPGMNHRVEITEGILADECAALLSD

FFRMRRQEIKAQKKAQSSTD
```

TadA*7.10:

```
                                         (SEQ ID NO: 2)
    MSEVEFSHEYW MRHALTLAKR ARDEREVPVG AVLVLNNRVI

GEGWNRAIGL HDPTAHAEIM ALRQGGLVMQ NYRLIDATLY

VTFEPCVMCA GAMIHSRIGR VVFGVRNAKT GAAGSLMDVL

HYPGMNHRVE ITEGILADEC AALLCYFFRM PRQVFNAQKK

AQSSTD
```

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In some embodiments the TadA deaminase is a full-length *E. coli* TadA deaminase. For example, in certain embodiments, the adenosine deaminase comprises the amino acid sequence:

(SEQ ID NO: 102)
MRRAFITGVFFLSEVEFSHEYWMRHALTLAKRAWDEREVPVGAVLVHNN

RVIGEGWNRPIGRHDPTAHAEIMALRQGGLVMQNYRLIDATLYVTLEPC

VMCAGAMIHSRIGRVVFGARDAKTGAAGSLMDVLHHPGMNHRVEITEGI

LADECAALLSDFFRMRRQEIKAQKKAQSSTD.

It should be appreciated, however, that additional adenosine deaminases useful in the present application would be apparent to the skilled artisan and are within the scope of this disclosure. For example, the adenosine deaminase may be a homolog of adenosine deaminase acting on tRNA (ADAT). Without limitation, the amino acid sequences of exemplary AD AT homologs include the following:

*Staphylococcus aureus* TadA:

(SEQ ID NO: 18)
MGSHMTNDIYFMTLAIEEAKKAAQLGEVPIGAIITKDDEVIARAHNLRE

TLQQPTAHAEHIAIERAAKVLGSWRLEGCTLYVTLEPCVMCAGTIVMSR

IPRVVYGADDPKGGCSGSLMNLLQQSNFNHRAIVDKGVLKEACSTLLTT

FFKNLRANKKSTN

*Bacillus subtilis* TadA:

(SEQ ID NO: 19)
MIQDELYMKEAIKEAKKAEEKGEVPIGAVLVINGETIARAHNLRETEQR

SIAHAEMLVIDEACKALGTWRLEGATLYVTLEPCPMCAGAVVLSRVEKV

VFGAFDPKGGCSGTLMNLLQEERFNHQAEVVSGVLEEECGGMLSAFFRE

LRKKKKAARKNLSE

*Salmonella typhimurium* (*S. typhimurium*) TadA:

(SEQ ID NO: 20)
MPPAFITGVISLSDVELDHEYWMRHALTLAKRAWDEREVPVGAVLVHNH

RVIGEGWNRPIGRHDPTAHAEIMALRQGGLVLQNYRLLDTTLYVTLEPC

VMCAGAMVHSRIGRVVFGARDAKTGAAGSLIDVLHHPGMNHRVEIIEGV

LRDECAILLSDFFRMRRQEIKALKKADRAEGAGPAV

*Shewanella putrefaciens* (*S. putrefaciens*) TadA:

(SEQ ID NO: 21)
MDEYWMQVAMQMAEKAEAAGEVPVGAVLVKDGQQIATGYNLSISQHDPT

AHAEILCLRSAGKKLENYRLLDATLYITLEPCAMCAGAMVHSRIARVVY

GARDEKTGAAGTVVNLLQHPAFNHQVEVTSGVLAEACSAQLSRFFKRRR

DEKKALKLAQRAQQGIE

*Haemophilus influenzae* F3031 (*H. influenzae*) TadA:

(SEQ ID NO: 22)
MDAAKVRSEFDEKMMRYALELADKAEALGEIPVGAVLVDDARNIIGEGW

NLSIVQSDPTAHAEIIALRNGAKNIQNYRLLNSTLYVTLEPCTMCAGAI

LHSRIKRLVFGASDYKTGAIGSRFHFFDDYKMNHTLEITSGVLAEECSQ

KLSTFFQKRREEKKIEKALLKSLSDK

*Caulobacter crescentus* (*C. crescentus*) TadA:

(SEQ ID NO: 23)
MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI

*Geobacter sulfurreducens* (*G. sulfurreducens*) TadA:

(SEQ ID NO: 24)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

An embodiment of *E. Coli* TadA (ecTadA) includes the following:

(SEQ ID NO: 103)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD

In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus,* or *Bacillus subtilis*. In some embodiments, the adenosine deaminase is from *E. coli*.

In one embodiment, a fusion protein of the invention comprises a wild-type TadA linked to TadA7.10, which is linked to Cas9 nickase. In particular embodiments, the fusion proteins comprise a single TadA7.10 domain (e.g., provided as a monomer). In other embodiments, the ABE7.10 editor comprises TadA7.10 and TadA(wt), which are capable of forming heterodimers.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

It should be appreciated that any of the mutations provided herein (e.g., based on the TadA reference sequence) can be introduced into other adenosine deaminases, such as E. coli TadA (ecTadA), S. aureus TadA (saTadA), or other adenosine deaminases (e.g., bacterial adenosine deaminases). It would be apparent to the skilled artisan that additional deaminases may similarly be aligned to identify homologous amino acid residues that can be mutated as provided herein. Thus, any of the mutations identified in the TadA reference sequence can be made in other adenosine deaminases (e.g., ecTada) that have homologous amino acid residues. It should also be appreciated that any of the mutations provided herein can be made individually or in any combination in the TadA reference sequence or another adenosine deaminase.

In some embodiments, the adenosine deaminase comprises a D108X mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a D108G, D108N, D108V, D108A, or D108Y mutation, or a corresponding mutation in another adenosine deaminase.

In some embodiments, the adenosine deaminase comprises an A106X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A106V mutation in TadA reference sequence, or a corresponding mutation in another adenosine deaminase (e.g., wild type TadA or ecTadA).

In some embodiments, the adenosine deaminase comprises a E155X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a E155D, E155G, or E155V mutation in TadA reference sequence, or a corresponding mutation in another adenosine deaminase (e.g., ecTadA).

In some embodiments, the adenosine deaminase comprises a D147X mutation in TadA reference sequence, or a corresponding mutation in another adenosine deaminase (e.g., ecTadA), where the presence of X indicates any amino acid other than the corresponding amino acid in the wild-type adenosine deaminase. In some embodiments, the adenosine deaminase comprises a D147Y, mutation in TadA reference sequence, or a corresponding mutation in another adenosine deaminase (e.g., ecTadA).

In some embodiments, the adenosine deaminase comprises an A106X, E155X, or D147X, mutation in the TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E155D, E155G, or E155V mutation. In some embodiments, the adenosine deaminase comprises a D147Y.

For example, an adenosine deaminase can contain a D108N, a A106V, a E155V, and/or a D147Y mutation in TadA reference sequence, or a corresponding mutation in another adenosine deaminase (e.g., ecTadA). In some embodiments, an adenosine deaminase comprises the following group of mutations (groups of mutations are separated by a ";") in TadA reference sequence, or corresponding mutations in another adenosine deaminase (e.g., ecTadA): D108N and A106V; D108N and E155V; D108N and D147Y; A106V and E155V; A106V and D147Y; E155V and D147Y; D108N, A106V, and E155V; D108N, A106V, and D147Y; D108N, E155V, and D147Y; A106V, E155V, and D 147Y; and D108N, A106V, E155V, and D147Y. It should be appreciated, however, that any combination of corresponding mutations provided herein can be made in an adenosine deaminase (e.g., ecTadA).

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95L, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in TadA reference sequence, or one or more corresponding mutations in another adenosine deaminase (e.g., ecTadA).

In some embodiments, the adenosine deaminase comprises one or more of a H8X, D108X, and/or N127X mutation in TadA reference sequence, or one or more corresponding mutations in another adenosine deaminase (e.g., ecTadA), where X indicates the presence of any amino acid. In some embodiments, the adenosine deaminase comprises one or more of a H8Y, D108N, and/or N127S mutation in TadA reference sequence, or one or more corresponding mutations in another adenosine deaminase (e.g., ecTadA).

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in TadA reference sequence, or one or more corresponding mutations in another adenosine deaminase (e.g., ecTadA), where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in the TadA reference sequence, or one or more corresponding mutations in another adenosine deaminase (e.g., ecTadA).

In some embodiments, the adenosine deaminase comprises one, two, three, four, five, or six mutations selected from the group consisting of H8X, D108X, N127X, D147X, R152X, and Q154X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in the TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R26X, L68X, D108X, N127X, D147X, and E155X, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, M61I, M70V, D108N, N127S, Q154R, E155G and Q163H in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, N127S, E155V, and T166P in TadA reference sequence, or a corresponding mutation or mutations in another adenosine deaminase (e.g., ecTadA). In some embodiments, the adenosine deaminase comprises one, two, three, four, five, or six mutations selected from the group consisting of H8Y, A106T, D108N, N127S, E155D, and K161Q in TadA reference sequence, or a corresponding mutation or mutations in another adenosine deaminase (e.g., ecTadA). In some embodiments, the adenosine deaminase comprises one, two, three, four, five, six, seven, or eight mutations selected from the group consisting of H8Y, R26W, L68Q, D108N, N127S, D147Y, and E155V in TadA reference sequence, or a corresponding mutation or mutations in another adenosine deaminase (e.g., ecTadA). In some embodiments, the adenosine deaminase comprises one, two, three, four, or five, mutations selected from the group consisting of H8Y, D108N, A109T, N127S, and E155G in TadA reference sequence, or a corresponding mutation or mutations in another adenosine deaminase (e.g., ecTadA).

Any of the mutations provided herein and any additional mutations (e.g., based on the ecTadA amino acid sequence) can be introduced into any other adenosine deaminases. Any of the mutations provided herein can be made individually or in any combination in TadA reference sequence or another adenosine deaminase (e.g., ecTadA).

Details of A to G nucleobase editing proteins are described in International PCT Application No. PCT/2017/045381 (WO2018/027078) and Gaudelli, N. M., et al., "Programmable base editing of A•T to G•C in genomic DNA without DNA cleavage" Nature, 551, 464-471 (2017), the entire contents of which are hereby incorporated by reference.

In some embodiments, the adenosine deaminase comprises one or more corresponding mutations in another adenosine deaminase (e.g., ecTadA). In some embodiments, the adenosine deaminase comprises a D108N, D108G, or D108V mutation in TadA reference sequence, or corresponding mutations in another adenosine deaminase (e.g., ecTadA). In some embodiments, the adenosine deaminase comprises a A106V and D108N mutation in TadA reference sequence, or corresponding mutations in another adenosine deaminase (e.g., ecTadA). In some embodiments, the adenosine deaminase comprises R107C and D108N mutations in TadA reference sequence, or corresponding mutations in another adenosine deaminase (e.g., ecTadA). In some embodiments, the adenosine deaminase comprises a H8Y, D108N, N127S, D147Y, and Q154H mutation in TadA reference sequence, or corresponding mutations in another adenosine deaminase (e.g., ecTadA). In some embodiments, the adenosine deaminase comprises a H8Y, D108N, N127S, D147Y, and E155V mutation in TadA reference sequence, or corresponding mutations in another adenosine deaminase (e.g., ecTadA). In some embodiments, the adenosine deaminase comprises a D108N, D147Y, and E155V mutation in TadA reference sequence, or corresponding mutations in another adenosine deaminase (e.g., ecTadA). In some embodiments, the adenosine deaminase comprises a H8Y, D108N, and N127S mutation in TadA reference sequence, or corresponding mutations in another adenosine deaminase (e.g., ecTadA). In some embodiments, the adenosine deaminase comprises a A106V, D108N, D147Y and E155V mutation in TadA reference sequence, or corresponding mutations in another adenosine deaminase (e.g., ecTadA).

In some embodiments, the adenosine deaminase comprises one or more of a S2X, H8X, I49X, L84X, H123X, N127X, I156X and/or K160X mutation in TadA reference sequence, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in TadA reference sequence, or one or more corresponding mutations in another adenosine deaminase (e.g., ecTadA).

In some embodiments, the adenosine deaminase comprises an L84X mutation adenosine deaminase, where X indicates any amino acid other than the corresponding amino acid in the wild-type adenosine deaminase. In some embodiments, the adenosine deaminase comprises an L84F mutation in TadA reference sequence, or a corresponding mutation in another adenosine deaminase (e.g., ecTadA).

In some embodiments, the adenosine deaminase comprises an H123X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H123Y mutation in TadA reference sequence, or a corresponding mutation in another adenosine deaminase (e.g., ecTadA).

In some embodiments, the adenosine deaminase comprises an I156X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an I156F mutation in TadA reference sequence, or a corresponding mutation in another adenosine deaminase (e.g., ecTadA).

In some embodiments, the adenosine deaminase comprises one, two, three, four, five, six, or seven mutations selected from the group consisting of L84X, A106X, D108X, H123X, D147X, E155X, and I156X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in TadA reference sequence, or a corresponding mutation or mutations in another adenosine deaminase (e.g., ecTadA), where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in TadA reference sequence, or a corresponding mutation or mutations in another adenosine deaminase (e.g., ecTadA), where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in TadA reference sequence, or a corresponding mutation or mutations in another adenosine deaminase (e.g., ecTadA). In some embodiments, the adenosine deaminase comprises one, two, three, four, five, or six mutations selected from the group consisting of S2A, I49F, A106V, D108N, D147Y, and E155V in TadA reference sequence.

In some embodiments, the adenosine deaminase comprises one, two, three, four, or five, mutations selected from the group consisting of H8Y, A106T, D108N, N127S, and K160S in TadA reference sequence, or a corresponding mutation or mutations in another adenosine deaminase (e.g., ecTadA).

In some embodiments, the adenosine deaminase comprises one or more of a E25X, R26X, R107X, A142X, and/or A143X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R107K, R107A, R107N, R107W, R107H, R107S, A142N, A142D, A142G, A143D, A143G, A143E, A143L, A143W, A143M, A143S, A143Q and/or A143R mutation in TadA reference sequence, or one or more corresponding mutations in another adenosine deaminase (e.g., ecTadA). In some embodiments, the adenosine deaminase comprises one or more of the mutations described herein corresponding to TadA reference sequence, or one or more corresponding mutations in another adenosine deaminase (e.g., ecTadA).

In some embodiments, the adenosine deaminase comprises an E25X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an E25M, E25D, E25A, E25R, E25V, E25S, or E25Y mutation in TadA reference sequence, or a corresponding mutation in another adenosine deaminase (e.g., ecTadA).

In some embodiments, the adenosine deaminase comprises an R26X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises R26G, R26N, R26Q, R26C, R26L, or R26K mutation in TadA reference sequence, or a corresponding mutation in another adenosine deaminase (e.g., ecTadA).

In some embodiments, the adenosine deaminase comprises an R107X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an R107P, R107K, R107A, R107N, R107W, R107H, or R107S mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A142N, A142D, A142G, mutation in TadA reference sequence, or a corresponding mutation in another adenosine deaminase (e.g., ecTadA).

In some embodiments, the adenosine deaminase comprises an A143X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in TadA reference sequence, or a corresponding mutation in another adenosine deaminase (e.g., ecTadA).

In some embodiments, the adenosine deaminase comprises one or more of a H36X, N37X, P48X, I49X, R51X, M70X, N72X, D77X, E134X, S146X, Q154X, K157X, and/or K161X mutation in TadA reference sequence, or one or more corresponding mutations in another adenosine deaminase (e.g., ecTadA), where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in TadA reference sequence, or one or more corresponding mutations in another adenosine deaminase (e.g., ecTadA).

In some embodiments, the adenosine deaminase comprises an H36X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an H36L mutation in TadA reference sequence, or a corresponding mutation in another adenosine deaminase (e.g., ecTadA).

In some embodiments, the adenosine deaminase comprises an N37X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an N37T, or N37S mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an P48T, or P48L mutation in TadA reference sequence, or a corresponding mutation in another adenosine deaminase (e.g., ecTadA).

In some embodiments, the adenosine deaminase comprises an R51X mutation in TadA reference sequence, or a corresponding mutation in another adenosine deaminase, where X indicates any amino acid other than the corresponding amino acid in the wild-type adenosine deaminase. In some embodiments, the adenosine deaminase comprises an R51H, or R51L mutation in TadA reference sequence, or a corresponding mutation in another adenosine deaminase (e.g., ecTadA).

In some embodiments, the adenosine deaminase comprises an S146X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises an S146R, or S146C mutation in TadA reference sequence, or a corresponding mutation in another adenosine deaminase (e.g., ecTadA).

In some embodiments, the adenosine deaminase comprises an K157X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a K157N mutation in TadA reference sequence, or a corresponding mutation in another adenosine deaminase (e.g., ecTadA).

In some embodiments, the adenosine deaminase comprises an P48X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a P48S, P48T, or P48A mutation in TadA reference sequence, or a corresponding mutation in another adenosine deaminase (e.g., ecTadA).

In some embodiments, the adenosine deaminase comprises an A142X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a A142N mutation in TadA reference sequence, or a corresponding mutation in another adenosine deaminase (e.g., ecTadA).

In some embodiments, the adenosine deaminase comprises an W23X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a W23R, or W23L mutation in TadA reference sequence, or a corresponding mutation in another adenosine deaminase (e.g., ecTadA).

In some embodiments, the adenosine deaminase comprises an R152X mutation in TadA reference sequence, or a corresponding mutation in another adenosine deaminase (e.g., ecTadA), where X indicates any amino acid other than the corresponding amino acid in the wild-type adenosine deaminase. In some embodiments, the adenosine deaminase comprises a R152P, or R52H mutation in TadA reference sequence, or a corresponding mutation in another adenosine deaminase (e.g., ecTadA).

In one embodiment, the adenosine deaminase may comprise the mutations H36L, R51L, L84F, A106V, D108N, H123Y, S146C, D147Y, E155V, I156F, and K157N. In some embodiments, the adenosine deaminase comprises the following combination of mutations relative to TadA reference sequence, where each mutation of a combination is separated by a "_" and each combination of mutations is between parentheses:

(A106V_D108N),
(R107C_D108N),
(H8Y_D108N_N127S_D147Y_Q154H),
(H8Y_D108N_N127S_D147Y_E155V),
(D108N_D147Y_E155V),
(H8Y_D108N_N127S),
(H8Y_D108N_N127S_D147Y_Q154H),
(A106V_D108N_D147Y_E155V),
(D108Q_D147Y_E155V),
(D108M_D147Y_E155V),
(D108L_D147Y_E155V), (D108K_D147Y_E155V),
(D108I_D147Y_E155V),
(D108F_D147Y_E155V),
(A106V_D108N_D147Y),
(A106V_D108M_D147Y_E155V),
(E59A_A106V_D108N_D147Y_E155V),
(E59A cat dead_A106V_D108N_D147Y_E155V),
(L84F_A106V_D108N_H123Y_D147Y_E155V_I156Y),
(L84F_A106V_D108N_H123Y_D147Y_E155V_I156F),
(D103A_D104N),
(G22P_D103A_D104N),
(D103A_D104N_S138A),
(R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V_I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V I156F),
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V I156F),
(R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_D147Y_E155V_K157N),
(N37T_P48T_M70L_L84F_A106V_D108N_H123Y_D147Y_I49V_E155V_I156F),
(N37S_L84F_A106V_D108N_H123Y_D147Y_E155V_I156F_K161T),
(H36L_L84F_A106V_D108N_H123Y_D147Y_Q154H_E155V_I156F),
(N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_D147Y_E155V_I156F_K157N),
(H36L_L84F_A106V_D108N_H123Y_S146C_D147Y_E155V_I156F),
(L84F_A106V_D108N_H123Y_S146R_D147Y_E155V_I156F_K161T),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F104I_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_E155V_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T),
(L84F_A106V_D108N_H123Y_S146C_D147Y_E155V_I156F_K157N_K160E_K161T),
(L84F_A106V_D108N_H123Y_S146C_D147Y_E155V_I156F_K157N_K160E),
(R74Q_L84F_A106V_D108N_H123Y_D147Y_E155V_I156F),
(R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F),
(L84F_R98Q_A106V_D108N_H123Y_D147Y_E155V_I156F),
(L84F_A106V_D108N_H123Y_R129Q_D147Y_E155V_I156F),
(P48S_L84F_A106V_D108N_H123Y_A142N_D147Y_E155V_I156F),
(P48S_A142N),
(P48T_I49V_L84F_A106V_D108N_H123Y_A142N_D147Y_E155V_I156F_L157N),
(P48T_I49V_A142N),
(H36L_P48S_R51L_L84F_A106V_D108N_H123Y_S146C_D147Y_E155V_I156F_K157N),
(H36L_P48S_R51L_L84F_A106V_D108N_H123Y_S146C_A142N_D147Y_E155V_I156F
(H36L_P48T_I49V_R51L_L84F_A106V_D108N_H123Y_S146C_D147Y_E155V_I156F_K157N),
(H36L_P48T_I49V_R51L_L84F_A106V_D108N_H123Y_A142N_S146C_D147Y_E155V_I156F_K157N),
(H36L_P48A_R51L_L84F_A106V_D108N_H123Y_S146C_D147Y_E155V_I156F_K157N),
(H36L_P48A_R51L_L84F_A106V_D108N_H123Y_A142N_S146C_D147Y_E155V_I156F_K157N),
(H36L_P48A_R51L_L84F_A106V_D108N_H123Y_S146C_A142N_D147Y_E155V_I156F_K157N),
(W23L_H36L_P48A_R51L_L84F_A106V_D108N_H123Y_S146C_D147Y_E155V_I156F K157N),
(W23R_H36L_P48A_R51L_L84F_A106V_D108N_H123Y_S146C_D147Y_E155V_I156F_K157N),
(W23L_H36L_P48A_R51L_L84F_A106V_D108N_H123Y_S146R_D147Y_E155V_I156F_K161T),
(H36L_P48A_R51L_L84F_A106V_D108N_H123Y_S146C_D147Y_R152H_E155V_I156F_K157N), (H36L_P48A_R51L_L84F_A106V_D108N_H123Y_
S146C_D147Y_R152P_E155V_I156F_K157N),
(W23L_H36L_P48A_R51L_L84F_A106V_D108N_
H123Y_S146C_D147Y_R152P_E155V_I156F_K157N),
(W23L_H36L_P48A_R51L_L84F_A106V_D108N_
H123Y_A142A_S146C_D147Y_E155V_I156F_K157N),
(W23L_H36L_P48A_R51L_L84F_A106V_D108N_
H123Y_A142A_S146C_D147Y_R152P_E155V_
I156F_K157N),
(W23L_H36L_P48A_R51L_L84F_A106V_D108N_
H123Y_S146R_D147Y_E155V_I156F_K161T),
(W23R_H36L_P48A_R51L_L84F_A106V_D108N_
H123Y_S146C_D147Y_R152P_E155V_I156F_K157N),
(H36L_P48A_R51L_L84F_A106V_D108N_H123Y_
A142N_S146C_D147Y_R152P_E155V_I156F_K157N).

In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the adenosine deaminase is TadA*7.10. In some embodiments, TadA*7.10 comprises at least one alteration. In particular embodiments, TadA*7.10 comprises one or more of the following alterations or additional alterations to TadA*7.10: Y147T, Y147R, Q154S, Y123H, V82S, T166R, and Q154R. The alteration Y123H is also referred to herein as H123H (the alteration H123Y in TadA*7.10 reverted back to Y123H (wt)). In other embodiments, the TadA*7.10 comprises a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In particular embodiments, an adenosine deaminase variant comprises a deletion of the C terminus beginning at residue 149, 150, 151, 152, 153, 154, 155, 156, and 157.

In other embodiments, a base editor of the invention is a monomer comprising an adenosine deaminase variant (e.g., TadA*8) comprising one or more of the following alterations: Y147T, Y147R, Q154S, Y123H, V82S, T166R, and/or Q154R, relative to TadA7.10 or the TadA reference sequence. In other embodiments, the adenosine deaminase variant (TadA*8) is a monomer comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R. In other embodiments, a base editor is a heterodimer comprising a wild-type adenosine deaminase and an adenosine deaminase variant (e.g., TadA*8) comprising one or more of the following alterations Y147T, Y147R, Q154S, Y123H, V82S, T166R, and/or Q154R, relative to TadA7.10 or the TadA reference sequence. In other embodiments, the base editor is a heterodimer comprising a TadA*7.10 domain and an adenosine deaminase variant domain (e.g., TadA*8) comprising a combination of alterations selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In one embodiment, an adenosine deaminase is a TadA*8 that comprises or consists essentially of the following sequence or a fragment thereof having adenosine deaminase activity:

(SEQ ID NO: 17)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFR

MPRQVFNAQKKAQSSTD

In some embodiments, the TadA*8 is a truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In some embodiments the TadA*8 is TadA*8.1, TadA*8.2, TadA*8.3, TadA*8.4, TadA*8.5, TadA*8.6, TadA*8.7, TadA*8.8, TadA*8.9, TadA*8.10, TadA*8.11, TadA*8.12, TadA*8.13, TadA*8.14, TadA*8.15, TadA*8.16, TadA*8.17, TadA*8.18, TadA*8.19, TadA*8.20, TadA*8.21, TadA*8.22, TadA*8.23, TadA*8.24.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA(wt), which are capable of forming heterodimers. Exemplary sequences follow: TadA(wt), "the TadA reference sequence":

(SEQ ID NO: 101)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

RVVFGARDAKTGAAGSLMDVLHHPGMNHRVEITEGILADECAALLSDFFR

MRRQEIKAQKKAQSSTD

TadA*7.10:

(SEQ ID NO: 2)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCYFFR

MPRQVFNAQKKAQSSTD

TadA*8:

(SEQ ID NO: 17)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to a reference sequence, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences known in the art or described herein.

In particular embodiments, a TadA*8 comprises one or more mutations at any of the following positions shown in bold. In other embodiments, a TadA*8 comprises one or more mutations at any of the positions shown with underlining: MSEVEFSHEY WMRHALTLAK RARDEREVPV GAVLVLNNRV IGEGWNRAIG 50 LHDPTAHAEI MALRQGGLVM QNYRLIDATL YVTFEPCVMC AGAMIHSRIG 100 RVVFGVRNAK TGAAGSLMDV LH YPGMNHRV EITEGILADE CAALLCYFFR 150 MPR QVFNAQK KAQSSTD (SEQ ID NO: 2)

For example, the TadA*8 comprises alterations at amino acid position 82 and/or 166 (e.g., V82S, T166R) alone or in combination with any one or more of the following Y147T, Y147R, Q154S, Y123H, and/or Q154R, relative to TadA7.10 or wtTadA, or a corresponding sequence thereof. In particular embodiments, a combination of alterations are selected from the group of: Y147T+Q154R; Y147T+Q154S; Y147R+Q154S; V82S+Q154S; V82S+Y147R; V82S+Q154R; V82S+Y123H; I76Y+V82S; V82S+Y123H+Y147T; V82S+Y123H+Y147R; V82S+Y123H+Q154R; Y147R+Q154R+Y123H; Y147R+Q154R+I76Y; Y147R+Q154R+T166R; Y123H+Y147R+Q154R+I76Y; V82S+Y123H+Y147R+Q154R; and I76Y+V82S+Y123H+Y147R+Q154R.

In some embodiments, the adenosine deaminase is TadA*8, which comprises or consists essentially of the following sequence or a fragment thereof having adenosine deaminase activity:

(SEQ ID NO: 17)
MSEVEFSHEY WMRHALTLAK RARDEREVPV GAVLVLNNRV

IGEGWNRAIG LHDPTAHAEI MALRQGGLVM QNYRLIDATL

YVTFEPCVMC AGAMIHSRIG RVVFGVRNAK TGAAGSLMDV

LHYPGMNHRV EITEGILADE CAALLCTFFR MPRQVFNAQK

KAQSSTD

In some embodiments, the TadA*8 is truncated. In some embodiments, the truncated TadA*8 is missing 1, 2, 3, 4, 5, 6, 7, 8, 9, 10, 11, 12, 13, 14, 15, 6, 17, 18, 19, or 20 N-terminal amino acid residues relative to the full length TadA*8. In some embodiments, the truncated TadA*8 is missing 1, 2, 3, 4, 5, 6, 7, 8, 9, 10, 11, 12, 13, 14, 15, 6, 17, 18, 19, or 20 C-terminal amino acid residues relative to the full length TadA*8. In some embodiments the adenosine deaminase variant is a full-length TadA*8.

In one embodiment, a fusion protein of the invention comprises a wild-type TadA is linked to an adenosine deaminase variant described herein (e.g., TadA*8), which is linked to Cas9 nickase. In particular embodiments, the fusion proteins comprise a single TadA*8 domain (e.g., provided as a monomer). In other embodiments, the base editor comprises TadA*8 and TadA(wt), which are capable of forming heterodimers.

Additional Domains

A base editor described herein can include any domain which helps to facilitate the nucleobase editing, modification or altering of a nucleobase of a polynucleotide. In some embodiments, a base editor comprises a polynucleotide programmable nucleotide binding domain (e.g., Cas9), a nucleobase editing domain (e.g., deaminase domain), and one or more additional domains. In some embodiments, the additional domain can facilitate enzymatic or catalytic functions of the base editor, binding functions of the base editor, or be inhibitors of cellular machinery (e.g., enzymes) that could interfere with the desired base editing result. In some embodiments, a base editor can comprise a nuclease, a nickase, a recombinase, a deaminase, a methyltransferase, a methylase, an acetylase, an acetyltransferase, a transcriptional activator, or a transcriptional repressor domain.

In some embodiments, a base editor can comprise an uracil glycosylase inhibitor (UGI) domain. In some embodiments, cellular DNA repair response to the presence of U: G heteroduplex DNA can be responsible for a decrease in nucleobase editing efficiency in cells. In such embodiments, uracil DNA glycosylase (UDG) can catalyze removal of U from DNA in cells, which can initiate base excision repair (BER), mostly resulting in reversion of the U:G pair to a C:G pair. In such embodiments, BER can be inhibited in base editors comprising one or more domains that bind the single strand, block the edited base, inhibit UGI, inhibit BER, protect the edited base, and/or promote repairing of the non-edited strand. Thus, this disclosure contemplates a base editor fusion protein comprising a UGI domain.

In some embodiments, a base editor comprises as a domain all or a portion of a double-strand break (DSB) binding protein. For example, a DSB binding protein can include a Gam protein of bacteriophage Mu that can bind to the ends of DSBs and can protect them from degradation. See Komor, A. C., et al., "Improved base excision repair inhibition and bacteriophage Mu Gam protein yields C:G-to-T:A base editors with higher efficiency and product purity" Science Advances 3:eaao4774 (2017), the entire content of which is hereby incorporated by reference.

Additionally, in some embodiments, a Gam protein can be fused to an N terminus of a base editor. In some embodiments, a Gam protein can be fused to a C-terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some embodiments, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitution(s) in any domain does/do not change the length of the base editor.

In some embodiments, a base editor can comprise as a domain all or a portion of a nucleic acid polymerase (NAP). For example, a base editor can comprise all or a portion of a eukaryotic NAP. In some embodiments, a NAP or portion thereof incorporated into a base editor is a DNA polymerase. In some embodiments, a NAP or portion thereof incorporated into a base editor has translesion polymerase activity. In some embodiments, a NAP or portion thereof incorporated into a base editor is a translesion DNA polymerase. In some embodiments, a NAP or portion thereof incorporated into a base editor is a Rev7, Rev1 complex, polymerase iota, polymerase kappa, or polymerase eta. In some embodiments, a NAP or portion thereof incorporated into a base editor is a eukaryotic polymerase alpha, beta, gamma, delta, epsilon, gamma, eta, iota, kappa, lambda, mu, or nu component. In some embodiments, a NAP or portion thereof incorporated into a base editor comprises an amino acid sequence that is at least 75%, 80%, 85%, 90%, 95%, 96%, 97%, 98%, 99%, or 99.5% identical to a nucleic acid polymerase (e.g., a translesion DNA polymerase).

Base Editor System

Use of the base editor system provided herein comprises the steps of: (a) contacting a target nucleotide sequence of a polynucleotide (e.g., double- or single stranded DNA or RNA) of a subject with a base editor system comprising a nucleobase editor (e.g., an adenosine base editor) and a guide polynucleic acid (e.g., gRNA), wherein the target nucleotide sequence comprises a targeted nucleobase pair; (b) inducing strand separation of said target region; (c) converting a first nucleobase of said target nucleobase pair in a single strand of the target region to a second nucleobase; and (d) cutting no more than one strand of said target region, where a third nucleobase complementary to the first nucleobase base is replaced by a fourth nucleobase complementary to the second nucleobase. It should be appreciated that in some embodiments, step (b) is omitted. In some embodiments, said targeted nucleobase pair is a plurality of nucleobase pairs in one or more genes. In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more genes, wherein at least one gene is located in a different locus.

In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine.

Base editing system as provided herein provides a new approach to genome editing that uses a fusion protein containing a catalytically defective *Streptococcus pyogenes* Cas9, an adenosine deaminase, and an inhibitor of base excision repair to induce programmable, single nucleotide (C→T or A→G) changes in DNA without generating double-strand DNA breaks, without requiring a donor DNA template, and without inducing an excess of stochastic insertions and deletions.

Provided herein are systems, compositions, and methods for editing a nucleobase using a base editor system. In some embodiments, the base editor system comprises (1) a base editor (BE) comprising a polynucleotide programmable nucleotide binding domain and a nucleobase editing domain (e.g., a deaminase domain) for editing the nucleobase; and (2) a guide polynucleotide (e.g., guide RNA) in conjunction with the polynucleotide programmable nucleotide binding domain. In some embodiments, the base editor system comprises an adenosine base editor (ABE). In some embodiments, the polynucleotide programmable nucleotide binding domain is a polynucleotide programmable DNA binding domain. In some embodiments, the polynucleotide programmable nucleotide binding domain is a polynucleotide programmable RNA binding domain. In some embodiments, the nucleobase editing domain is a deaminase domain. In some embodiments, a deaminase domain can be an adenine deaminase or an adenosine deaminase. In some embodiments, the adenosine base editor can deaminate adenine in DNA. In some embodiments, ABE comprises an evolved TadA variant.

Details of nucleobase editing proteins are described in International PCT Application Nos. PCT/2017/045381 (WO2018/027078) and PCT/US2016/058344 (WO2017/070632), each of which is incorporated herein by reference for its entirety. Also see Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, a single guide polynucleotide may be utilized to target a deaminase to a target nucleic acid sequence. In some embodiments, a single pair of guide polynucleotides may be utilized to target different deaminases to a target nucleic acid sequence.

The nucleobase components and the polynucleotide programmable nucleotide binding component of a base editor system may be associated with each other covalently or non-covalently. For example, in some embodiments, the deaminase domain can be targeted to a target nucleotide sequence by a polynucleotide programmable nucleotide binding domain. In some embodiments, a polynucleotide programmable nucleotide binding domain can be fused or linked to a deaminase domain. In some embodiments, a polynucleotide programmable nucleotide binding domain can target a deaminase domain to a target nucleotide sequence by non-covalently interacting with or associating with the deaminase domain. For example, in some embodiments, the nucleobase editing component, e.g., the deaminase component can comprise an additional heterologous portion or domain that is capable of interacting with, associating with, or capable of forming a complex with an additional heterologous portion or domain that is part of a polynucleotide programmable nucleotide binding domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a steril alpha motif, a telomerase Ku binding motif and Ku protein, a telomerase Sm7 binding motif and Sm7 protein, or an RNA recognition motif.

A base editor system may further comprise a guide polynucleotide component. It should be appreciated that components of the base editor system may be associated with each other via covalent bonds, noncovalent interactions, or any combination of associations and interactions thereof. In some embodiments, a deaminase domain can be targeted to a target nucleotide sequence by a guide polynucleotide. For example, in some embodiments, the nucleobase editing component of the base editor system, e.g., the deaminase component, can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain (e.g., polynucleotide binding domain such as an RNA or DNA binding protein) can be fused or linked to the deaminase domain. In some embodiments, the additional heterologous portion may be capable of binding to, interacting with, associating with, or forming a complex with a polypeptide. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, a base editor system can further comprise an inhibitor of base excision repair (BER) component. It should be appreciated that components of the base editor system may be associated with each other via covalent bonds, noncovalent interactions, or any combination of associations and interactions thereof. The inhibitor of BER component may comprise a base excision repair inhibitor. In some embodiments, the inhibitor of base excision repair can be a uracil DNA glycosylase inhibitor (UGI). In some embodiments, the inhibitor of base excision repair can be an inosine base excision repair inhibitor. In some embodiments, the inhibitor of base excision repair can be targeted to the target nucleotide sequence by the polynucleotide programmable nucleotide binding domain. In some embodiments, a polynucleotide programmable nucleotide binding domain can be fused or linked to an inhibitor of base excision repair. In some embodiments, a polynucleotide programmable nucleotide binding domain can be fused or linked to a deaminase domain and an inhibitor of base excision repair. In some embodiments, a polynucleotide programmable nucleotide binding domain can target an inhibitor of base excision repair to a target nucleotide sequence by non-covalently interacting with or associating with the inhibitor of base excision repair. For example, in some embodiments, the inhibitor of base excision repair component can comprise an additional heterologous portion or domain that is capable of interacting with, associating with, or capable of forming a complex with an additional heterologous portion or domain that is part of a polynucleotide programmable nucleotide binding domain. In some embodiments, the inhibitor of base excision repair can be targeted to the target nucleotide sequence by the guide polynucleotide. For example, in some embodiments, the inhibitor of base excision repair can comprise an additional heterologous portion or domain (e.g., polynucleotide binding domain such as an RNA or DNA binding protein) that is capable of interacting with, associating with, or capable of forming a complex with a portion or segment (e.g., a polynucleotide motif) of a guide polynucleotide. In some embodiments, the additional heterologous portion or domain of the guide polynucleotide (e.g., polynucleotide binding domain such as an RNA or DNA binding protein) can be fused or linked to the inhibitor of base excision repair. In some embodiments, the additional heterologous portion may be capable of binding to, interacting with, associating with, or forming a complex with a polynucleotide. In some embodiments, the additional heterologous portion may be capable of binding to a guide polynucleotide. In some embodiments, the additional heterologous portion may be capable of binding to a polypeptide linker. In some embodiments, the additional heterologous portion may be capable of binding to a polynucleotide linker. The additional heterologous portion may be a protein domain. In some embodiments, the additional heterologous portion may be a K Homology (KH) domain, a MS2 coat protein domain, a PP7 coat protein domain, a SfMu Com coat protein domain, a sterile alpha motif, a telomerase Ku binding motif and Ku protein, a telomerase Sm7 binding motif and Sm7 protein, or a RNA recognition motif.

In some embodiments, the base editor inhibits base excision repair (BER) of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edit of base pair is upstream of a PAM site. In some embodiments, the intended edit of base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edit of base-pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site.

In some embodiments, the method does not require a canonical (e.g., NGG) PAM site. In some embodiments, the nucleobase editor comprises a linker or a spacer. In some embodiments, the linker or spacer is 1-25 amino acids in length. In some embodiments, the linker or spacer is 5-20 amino acids in length. In some embodiments, the linker or spacer is 10, 11, 12, 13, 14, 15, 16, 17, 18, 19, or 20 amino acids in length.

In some embodiments, the base editing fusion proteins provided herein need to be positioned at a precise location, for example, where a target base is placed within a defined region (e.g., a "deamination window"). In some embodiments, a target can be within a 4 base region. In some embodiments, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

In some embodiments, the target region comprises a target window, wherein the target window comprises the target nucleobase pair. In some embodiments, the target window comprises 1-10 nucleotides. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edit of base pair is within the target window. In some embodiments, the target window comprises the intended edit of base pair. In some embodiments, the method is performed using any of the base editors provided herein. In some embodiments, a target window is a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a polynucleotide programmable nucleotide binding domain. In some embodiments, an NLS of the base editor is localized C-terminal to a polynucleotide programmable nucleotide binding domain.

Other exemplary features that can be present in a base editor as disclosed herein are localization sequences, such as cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Non-limiting examples of protein domains which can be included in the fusion protein include deaminase domains (e.g., adenosine deaminase), a uracil glycosylase inhibitor (UGI) domain, epitope tags, and reporter gene sequences.

Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including, but not limited to, maltose binding protein (MBP), S-tag, Lex A DNA binding domain (DBD) fusions, GAL4 DNA binding domain fusions, and herpes simplex virus (HSV) BP16 protein fusions.

In some embodiments, the adenosine base editor (ABE) can deaminate adenine in DNA. In some embodiments, ABE is generated by replacing APOBEC1 component of BE3 with natural or engineered E. coli TadA, human ADAR2, mouse ADA, or human ADAT2. In some embodiments, ABE comprises evolved TadA variant. In some embodiments, the ABE is ABE 1.2 (TadA*-XTEN-nCas9-NLS). In some embodiments, TadA* comprises A106V and D108N mutations.

In some embodiments, the ABE is a second-generation ABE. In some embodiments, the ABE is ABE2.1, which comprises additional mutations D147Y and E155V in TadA* (TadA*2.1). In some embodiments, the ABE is ABE2.2, ABE2.1 fused to catalytically inactivated version of human alkyl adenine DNA glycosylase (AAG with E125Q mutation). In some embodiments, the ABE is ABE2.3, ABE2.1 fused to catalytically inactivated version of E. coli Endo V (inactivated with D35A mutation). In some embodiments, the ABE is ABE2.6 which has a linker twice as long (32 amino acids, $(SGGS)_2$-XTEN-$(SGGS)_2$ ("$(SGGS)_2$" disclosed as SEQ ID NO: 104)) as the linker in ABE2.1. In some embodiments, the ABE is ABE2.7, which is ABE2.1 tethered with an additional wild-type TadA monomer. In some embodiments, the ABE is ABE2.8, which is ABE2.1 tethered with an additional TadA*2.1 monomer. In some embodiments, the ABE is ABE2.9, which is a direct fusion of evolved TadA (TadA*2.1) to the N-terminus of ABE2.1. In some embodiments, the ABE is ABE2.10, which is a direct fusion of wild type TadA to the N-terminus of ABE2.1. In some embodiments, the ABE is ABE2.11, which is ABE2.9 with an inactivating E59A mutation at the N-terminus of TadA* monomer. In some embodiments, the ABE is ABE2.12, which is ABE2.9 with an inactivating E59A mutation in the internal TadA* monomer.

In some embodiments, the ABE is a third generation ABE. In some embodiments, the ABE is ABE3.1, which is ABE2.3 with three additional TadA mutations (L84F, H123Y, and I156F).

In some embodiments, the ABE is a fourth generation ABE. In some embodiments, the ABE is ABE4.3, which is ABE3.1 with an additional TadA mutation A142N (TadA*4.3).

In some embodiments, the ABE is a fifth generation ABE. In some embodiments, the ABE is ABE5.1, which is generated by importing a consensus set of mutations from surviving clones (H36L, R51L, S146C, and K157N) into ABE3.1. In some embodiments, the ABE is ABE5.3, which has a heterodimeric construct containing wild-type E. coli TadA fused to an internal evolved TadA*. In some embodiments, the ABE is ABE5.2, ABE5.4, ABE5.5, ABE5.6, ABE5.7, ABE5.8, ABE5.9, ABE5.10, ABE5.11, ABE5.12, ABE5.13, or ABE5.14, as shown in below Table 6. In some embodiments, the ABE is a sixth generation ABE. In some embodiments, the ABE is ABE6.1, ABE6.2, ABE6.3, ABE6.4, ABE6.5, or ABE6.6, as shown in below Table 6. In some embodiments, the ABE is a seventh generation ABE. In some embodiments, the ABE is ABE7.1, ABE7.2, ABE7.3, ABE7.4, ABE7.5, ABE7.6, ABE7.7, ABE7.8, ABE 7.9, or ABE7.10, as shown in Table 6 below.

TABLE 6

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| ABE0.1 | W | R | H | N | P | | R | N | L | S | A | D | H | G | A | S | D | R | E | I | K | K |
| ABE0.2 | W | R | H | N | P | | R | N | L | S | A | D | H | G | A | S | D | R | E | I | K | K |
| ABE1.1 | W | R | H | N | P | | R | N | L | S | A | N | H | G | A | S | D | R | E | I | K | K |
| ABE1.2 | W | R | H | N | P | | R | N | L | S | V | N | H | G | A | S | D | R | E | I | K | K |
| ABE2.1 | W | R | H | N | P | | R | N | L | S | V | N | H | G | A | S | Y | R | V | I | K | K |
| ABE2.2 | W | R | H | N | P | | R | N | L | S | V | N | H | G | A | S | Y | R | V | I | K | K |
| ABE2.3 | W | R | H | N | P | | R | N | L | S | V | N | H | G | A | S | Y | R | V | I | K | K |
| ABE2.4 | W | R | H | N | P | | R | N | L | S | V | N | H | G | A | S | Y | R | V | I | K | K |
| ABE2.5 | W | R | H | N | P | | R | N | L | S | V | N | H | G | A | S | Y | R | V | I | K | K |
| ABE2.6 | W | R | H | N | P | | R | N | L | S | V | N | H | G | A | S | Y | R | V | I | K | K |
| ABE2.7 | W | R | H | N | P | | R | N | L | S | V | N | H | G | A | S | Y | R | V | I | K | K |
| ABE2.8 | W | R | H | N | P | | R | N | L | S | V | N | H | G | A | S | Y | R | V | I | K | K |
| ABE2.9 | W | R | H | N | P | | R | N | L | S | V | N | H | G | A | S | Y | R | V | I | K | K |
| ABE2.10 | W | R | H | N | P | | R | N | L | S | V | N | H | G | A | S | Y | R | V | I | K | K |
| ABE2.11 | W | R | H | N | P | | R | N | L | S | V | N | H | G | A | S | Y | R | V | I | K | K |
| ABE2.12 | W | R | H | N | P | | R | N | L | S | V | N | H | G | A | S | Y | R | V | I | K | K |
| ABE3.1 | W | R | H | N | P | | R | N | F | S | V | N | Y | G | A | S | Y | R | V | F | K | K |
| ABE3.2 | W | R | H | N | P | | R | N | F | S | V | N | Y | G | A | S | Y | R | V | F | K | K |
| ABE3.3 | W | R | H | N | P | | R | N | F | S | V | N | Y | G | A | S | Y | R | V | F | K | K |
| ABE3.4 | W | R | H | N | P | | R | N | F | S | V | N | Y | G | A | S | Y | R | V | F | K | K |
| ABE3.5 | W | R | H | N | P | | R | N | F | S | V | N | Y | G | A | S | Y | R | V | F | K | K |
| ABE3.6 | W | R | H | N | P | | R | N | F | S | V | N | Y | G | A | S | Y | R | V | F | K | K |
| ABE3.7 | W | R | H | N | P | | R | N | F | S | V | N | Y | G | A | S | Y | R | V | F | K | K |
| ABE3.8 | W | R | H | N | P | | R | N | F | S | V | N | Y | G | A | S | Y | R | V | F | K | K |
| ABE4.1 | W | R | H | N | P | | R | N | L | S | V | N | H | G | N | S | Y | R | V | I | K | K |
| ABE4.2 | W | G | H | N | P | | R | N | L | S | V | N | H | G | N | S | Y | R | V | I | K | K |
| ABE4.3 | W | R | H | N | P | | R | N | F | S | V | N | Y | G | N | S | Y | R | V | F | K | K |
| ABE5.1 | W | R | L | N | P | | L | N | F | S | V | N | Y | G | A | C | Y | R | V | F | N | K |
| ABE5.2 | W | R | H | S | P | | R | N | F | S | V | N | Y | G | A | S | Y | R | V | F | K | T |
| ABE5.3 | W | R | L | N | P | | L | N | I | S | V | N | Y | G | A | C | Y | R | V | I | N | K |
| ABE5.4 | W | R | H | S | P | | R | N | F | S | V | N | Y | G | A | S | Y | R | V | F | K | T |
| ABE5.5 | W | R | L | N | P | | L | N | F | S | V | N | Y | G | A | C | Y | R | V | F | N | K |
| ABE5.6 | W | R | L | N | P | | L | N | F | S | V | N | Y | G | A | C | Y | R | V | F | N | K |
| ABE5.7 | W | R | L | N | P | | L | N | F | S | V | N | Y | G | A | C | Y | R | V | F | N | K |
| ABE5.8 | W | R | L | N | P | | L | N | F | S | V | N | Y | G | A | C | Y | R | V | F | N | K |
| ABE5.9 | W | R | L | N | P | | L | N | F | S | V | N | Y | G | A | C | Y | R | V | F | N | K |
| ABE5.10 | W | R | L | N | P | | L | N | F | S | V | N | Y | G | A | C | Y | R | V | F | N | K |
| ABE5.11 | W | R | L | N | P | | L | N | F | S | V | N | Y | G | A | C | Y | R | V | F | N | K |
| ABE5.12 | W | R | L | N | P | | L | N | F | S | V | N | Y | G | A | C | Y | R | V | F | N | K |
| ABE5.13 | W | R | H | N | P | | L | D | F | S | V | N | Y | A | A | S | Y | R | V | F | K | K |
| ABE5.14 | W | R | H | N | S | | L | N | F | C | V | N | Y | G | A | S | Y | R | V | F | K | K |
| ABE6.1 | W | R | H | N | S | | L | N | F | S | V | N | Y | G | N | S | Y | R | V | F | K | K |
| ABE6.2 | W | R | H | N | T | V | L | N | F | S | V | N | Y | G | N | S | Y | R | V | F | K | K |
| ABE6.3 | W | R | L | N | S | | L | N | F | S | V | N | Y | G | A | C | Y | R | V | F | N | K |
| ABE6.4 | W | R | L | N | S | | L | N | F | S | V | N | Y | G | N | C | Y | R | V | F | N | K |
| ABE6.5 | W | R | L | N | I | V | L | N | F | S | V | N | Y | G | A | C | Y | R | V | F | N | K |
| ABE6.6 | W | R | L | N | T | V | L | N | F | S | V | N | Y | G | N | C | Y | R | V | F | N | K |
| ABE7.1 | W | R | L | N | A | | L | N | F | S | V | N | Y | G | A | C | Y | R | V | F | N | K |
| ABE7.2 | W | R | L | N | A | | L | N | F | S | V | N | Y | G | N | C | Y | R | V | F | N | K |
| ABE7.3 | I | R | L | N | A | | L | N | F | S | V | N | Y | G | A | C | Y | R | V | F | N | K |
| ABE7.4 | R | R | L | N | A | | L | N | F | S | V | N | Y | G | A | C | Y | R | V | F | N | K |
| ABE7.5 | W | R | L | N | A | | L | N | F | S | V | N | Y | G | A | C | Y | H | V | F | N | K |
| ABE7.6 | W | R | L | N | A | | L | N | I | S | V | N | Y | G | A | C | Y | P | V | I | N | K |
| ABE7.7 | L | R | L | N | A | | L | N | F | S | V | N | Y | G | A | C | Y | P | V | F | N | K |
| ABE7.8 | I | R | L | N | A | | L | N | F | S | V | N | Y | G | N | C | Y | R | V | F | N | K |
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

In some embodiments, the base editor is an eighth generation ABE (ABE8). In some embodiments, the ABE8 contains a TadA*8 variant. In some embodiments, the ABE8 has a monomeric construct containing a TadA*8 variant ("ABE8.x-m"). In some embodiments, the ABE8 is ABE8.1-m, which has a monomeric construct containing TadA*7.10 with a Y147T mutation (TadA*8.1). In some embodiments, the ABE8 is ABE8.2-m, which has a monomeric construct containing TadA*7.10 with a Y147R mutation (TadA*8.2). In some embodiments, the ABE8 is ABE8.3-m, which has a monomeric construct containing TadA*7.10 with a Q154S mutation (TadA*8.3). In some embodiments, the ABE8 is ABE8.4-m, which has a monomeric construct containing TadA*7.10 with a Y123H mutation (TadA*8.4). In some embodiments, the ABE8 is ABE8.5-m, which has a monomeric construct containing TadA*7.10 with a V82S mutation (TadA*8.5). In some embodiments, the ABE8 is ABE8.6-m, which has a monomeric construct containing TadA*7.10 with a T166R mutation (TadA*8.6). In some embodiments, the ABE8 is ABE8.3-m, which has a monomeric construct containing TadA*7.10 with a Q154R mutation (TadA*8.7). In some embodiments, the ABE8 is ABE8.8-m, which has a monomeric construct containing TadA*7.10 with Y147R, Q154R, and Y123H mutations (TadA*8.8). In some embodiments, the ABE8 is ABE8.9-m, which has a monomeric construct containing TadA*7.10 with Y147R, Q154R and I76Y mutations (TadA*8.9). In some embodiments, the ABE8 is ABE8.10-m, which has a monomeric construct containing TadA*7.10 with Y147R, Q154R, and T166R mutations (TadA*8.10). In some embodiments, the ABE8 is ABE8.11-m, which has a monomeric construct containing TadA*7.10 with Y147T and Q154R mutations (TadA*8.11). In some embodiments, the ABE8 is ABE8.12-m, which has a monomeric construct containing TadA*7.10 with Y147T and Q154S mutations (TadA*8.12). In some embodiments, the ABE8 is ABE8.13-m, which has a monomeric construct containing TadA*7.10 with Y123H (Y123H reverted from H123Y), Y147R, Q154R and I76Y mutations (TadA*8.13). In some embodiments, the ABE8 is ABE8.14-m, which has a monomeric construct containing TadA*7.10 with I76Y and V82S mutations (TadA*8.14). In some embodiments, the ABE8 is ABE8.15-m, which has a monomeric construct containing TadA*7.10 with V82S and Y147R mutations (TadA*8.15). In some embodiments, the ABE8 is ABE8.16-m, which has a monomeric construct containing TadA*7.10 with V82S, Y123H (Y123H reverted from H123Y) and Y147R mutations (TadA*8.16). In some embodiments, the ABE8 is ABE8.17-m, which has a monomeric construct containing TadA*7.10 with V82S and Q154R mutations (TadA*8.17). In some embodiments, the ABE8 is ABE8.18-m, which has a monomeric construct containing TadA*7.10 with V82S, Y123H (Y123H reverted from H123Y) and Q154R mutations (TadA*8.18). In some embodiments, the ABE8 is ABE8.19-m, which has a monomeric construct containing TadA*7.10 with V82S, Y123H (Y123H reverted from H123Y), Y147R and Q154R mutations (TadA*8.19). In some embodiments, the ABE8 is ABE8.20-m, which has a monomeric construct containing TadA*7.10 with I76Y, V82S, Y123H (Y123H reverted from H123Y), Y147R and Q154R mutations (TadA*8.20). In some embodiments, the ABE8 is ABE8.21-m, which has a monomeric construct containing TadA*7.10 with Y147R and Q154S mutations (TadA*8.21). In some embodiments, the ABE8 is ABE8.22-m, which has a monomeric construct containing TadA*7.10 with V82S and Q154S mutations (TadA*8.22). In some embodiments, the ABE8 is ABE8.23-m, which has a monomeric construct containing TadA*7.10 with V82S and Y123H (Y123H reverted from H123Y) mutations (TadA*8.23). In some embodiments, the ABE8 is ABE8.24-m, which has a monomeric construct containing TadA*7.10 with V82S, Y123H (Y123H reverted from H123Y), and Y147T mutations (TadA*8.24).

In some embodiments, the ABE8 has a heterodimeric construct containing wild-type E. coli TadA fused to a TadA*8 variant ("ABE8.x-d"). In some embodiments, the ABE8 is ABE8.1-d, which has a heterodimeric construct containing wild-type E. coli TadA fused to TadA*7.10 with a Y147T mutation (TadA*8.1). In some embodiments, the ABE8 is ABE8.2-d, which has a heterodimeric construct containing wild-type E. coli TadA fused to TadA*7.10 with a Y147R mutation (TadA*8.2). In some embodiments, the ABE8 is ABE8.3-d, which has a heterodimeric construct containing wild-type E. coli TadA fused to TadA*7.10 with a Q154S mutation (TadA*8.3). In some embodiments, the ABE8 is ABE8.4-d, which has a heterodimeric construct containing wild-type E. coli TadA fused to TadA*7.10 with a Y123H mutation (TadA*8.4). In some embodiments, the ABE8 is ABE8.5-d, which has a heterodimeric construct containing wild-type E. coli TadA fused to TadA*7.10 with a V82S mutation (TadA*8.5). In some embodiments, the ABE8 is ABE8.6-d, which has a heterodimeric construct containing wild-type E. coli TadA fused to TadA*7.10 with a T166R mutation (TadA*8.6). In some embodiments, the ABE8 is ABE8.3-d, which has a heterodimeric construct containing wild-type E. coli TadA fused to TadA*7.10 with a Q154R mutation (TadA*8.7). In some embodiments, the ABE8 is ABE8.8-d, which has a heterodimeric construct containing wild-type E. coli TadA fused to TadA*7.10 with Y147R, Q154R, and Y123H mutations (TadA*8.8). In some embodiments, the ABE8 is ABE8.9-d, which has a heterodimeric construct containing wild-type E. coli TadA fused to TadA*7.10 with Y147R, Q154R and I76Y mutations (TadA*8.9). In some embodiments, the ABE8 is ABE8.10-d, which has a heterodimeric construct containing wild-type E. coli TadA fused to TadA*7.10 with Y147R, Q154R, and T166R mutations (TadA*8.10). In some embodiments, the ABE8 is ABE8.11-d, which has a heterodimeric construct containing wild-type E. coli TadA fused to TadA*7.10 with Y147T and Q154R mutations (TadA*8.11). In some embodiments, the ABE8 is ABE8.12-d, which has heterodimeric construct containing wild-type E. coli TadA fused to TadA*7.10 with Y147T and Q154S mutations (TadA*8.12). In some embodiments, the ABE8 is ABE8.13-d, which has a heterodimeric construct containing wild-type E. coli TadA fused to TadA*7.10 with Y123H (Y123H reverted from H123Y), Y147R, Q154R and I76Y mutations (TadA*8.13). In some embodiments, the ABE8 is ABE8.14-d, which has a heterodimeric construct containing wild-type E. coli TadA fused to TadA*7.10 with I76Y and V82S mutations (TadA*8.14). In some embodiments, the ABE8 is ABE8.15-d, which has a heterodimeric construct containing wild-type E. coli TadA fused to TadA*7.10 with V82S and Y147R mutations (TadA*8.15). In some embodiments, the ABE8 is ABE8.16-d, which has a heterodimeric construct containing wild-type E. coli TadA fused to TadA*7.10 with V82S, Y123H (Y123H reverted from H123Y) and Y147R mutations (TadA*8.16). In some embodiments, the ABE8 is ABE8.17-d, which has a heterodimeric construct containing wild-type E. coli TadA fused to TadA*7.10 with V82S and Q154R mutations (TadA*8.17). In some embodiments, the ABE8 is ABE8.18-d, which has a heterodimeric construct containing wild-type E. coli TadA fused to TadA*7.10 with V82S, Y123H (Y123H reverted from H123Y) and Q154R mutations (TadA*8.18). In some embodiments, the ABE8 is ABE8.19-d, which has a heterodimeric construct containing wild-type E. coli TadA fused to TadA*7.10 with V82S, Y123H (Y123H reverted from H123Y), Y147R and Q154R mutations (TadA*8.19). In some embodiments, the ABE8 is ABE8.20-d, which has a heterodimeric construct containing wild-type E. coli TadA fused to TadA*7.10 with I76Y, V82S, Y123H (Y123H reverted from H123Y), Y147R and Q154R mutations (TadA*8.20). In some embodiments, the ABE8 is ABE8.21-d, which has a heterodimeric construct containing wild-type E. coli TadA fused to TadA*7.10 with Y147R and Q154S mutations (TadA*8.21). In some embodiments, the ABE8 is ABE8.22-d, which has a heterodimeric construct containing wild-type E. coli TadA fused to TadA*7.10 with V82S and Q154S mutations (TadA*8.22). In some embodiments, the ABE8 is ABE8.23-d, which has a heterodimeric construct containing wild-type E. coli TadA fused to TadA*7.10 with V82S and Y123H (Y123H reverted from H123Y) mutations (TadA*8.23). In some embodiments, the ABE8 is ABE8.24-d, which has a heterodimeric construct containing wild-type E. coli TadA fused to TadA*7.10 with V82S, Y123H (Y123H reverted from H123Y), and Y147T mutations (TadA*8.24).

In some embodiments, the ABE8 has a heterodimeric construct containing TadA*7.10 fused to a TadA*8 variant ("ABE8.x-7"). In some embodiments, the ABE8 is ABE8.1-7, which has a heterodimeric construct containing TadA*7.10 fused to TadA*7.10 with a Y147T mutation (TadA*8.1). In some embodiments, the ABE8 is ABE8.2-7, which has a heterodimeric construct containing TadA*7.10 fused to TadA*7.10 with a Y147R mutation (TadA*8.2). In some embodiments, the ABE8 is ABE8.3-7, which has a heterodimeric construct containing TadA*7.10 fused to TadA*7.10 with a Q154S mutation (TadA*8.3). In some embodiments, the ABE8 is ABE8.4-7, which has a heterodimeric construct containing TadA*7.10 fused to TadA*7.10 with a Y123H mutation (TadA*8.4). In some embodiments, the ABE8 is ABE8.5-7, which has a heterodimeric construct containing TadA*7.10 fused to TadA*7.10 with a V82S mutation (TadA*8.5). In some embodiments, the ABE8 is ABE8.6-7, which has a heterodimeric construct containing TadA*7.10 fused to TadA*7.10 with a T166R mutation (TadA*8.6). In some embodiments, the ABE8 is ABE8.3-7, which has a heterodimeric construct containing TadA*7.10 fused to TadA*7.10 with a Q154R mutation (TadA*8.7). In some embodiments, the ABE8 is ABE8.8-7, which has a heterodimeric construct containing TadA*7.10 fused to TadA*7.10 with Y147R, Q154R, and Y123H mutations (TadA*8.8). In some embodiments, the ABE8 is ABE8.9-7, which has a heterodimeric construct containing TadA*7.10 fused to TadA*7.10 with Y147R, Q154R and I76Y mutations (TadA*8.9). In some embodiments, the ABE8 is ABE8.10-7, which has a heterodimeric construct containing TadA*7.10 fused to TadA*7.10 with Y147R, Q154R, and T166R mutations (TadA*8.10). In some embodiments, the ABE8 is ABE8.11-7, which has a heterodimeric construct containing TadA*7.10 fused to TadA*7.10 with Y147T and Q154R mutations (TadA*8.11). In some embodiments, the ABE8 is ABE8.12-7, which has a heterodimeric construct containing TadA*7.10 fused to TadA*7.10 with Y147T and Q154S mutations (TadA*8.12). In some embodiments, the ABE8 is ABE8.13-7, which has a heterodimeric construct containing TadA*7.10 fused to TadA*7.10 with Y123H (Y123H reverted from H123Y), Y147R, Q154R and I76Y mutations (TadA*8.13). In some embodiments, the ABE8 is ABE8.14-7, which has a heterodimeric construct containing TadA*7.10 fused to TadA*7.10 with I76Y and V82S mutations (TadA*8.14). In some embodiments, the ABE8 is ABE8.15-7, which has a heterodimeric construct containing TadA*7.10 fused to TadA*7.10 with V82S and Y147R mutations (TadA*8.15). In some embodiments, the ABE8 is ABE8.16-7, which has a heterodimeric construct containing TadA*7.10 fused to TadA*7.10 with V82S, Y123H (Y123H reverted from H123Y) and Y147R mutations (TadA*8.16). In some embodiments, the ABE8 is ABE8.17-7, which has a heterodimeric construct containing TadA*7.10 fused to TadA*7.10 with V82S and Q154R mutations (TadA*8.17). In some embodiments, the ABE8 is ABE8.18-7, which has a heterodimeric construct containing TadA*7.10 fused to TadA*7.10 with V82S, Y123H (Y123H reverted from H123Y) and Q154R mutations (TadA*8.18). In some embodiments, the ABE8 is ABE8.19-7, which has a heterodimeric construct containing TadA*7.10 fused to TadA*7.10 with V82S, Y123H (Y123H reverted from H123Y), Y147R and Q154R mutations (TadA*8.19). In some embodiments, the ABE8 is ABE8.20-7, which has a heterodimeric construct containing TadA*7.10 fused to TadA*7.10 with I76Y, V82S, Y123H (Y123H reverted from H123Y), Y147R and Q154R mutations (TadA*8.20). In some embodiments, the ABE8 is ABE8.21-7, which has a heterodimeric construct containing TadA*7.10 fused to TadA*7.10 with Y147R and Q154S mutations (TadA*8.21). In some embodiments, the ABE8 is ABE8.22-7, which has a heterodimeric construct containing TadA*7.10 fused to TadA*7.10 with V82S and Q154S mutations (TadA*8.22). In some embodiments, the ABE8 is ABE8.23-7, which has a heterodimeric construct containing TadA*7.10 fused to TadA*7.10 with V82S and Y123H (Y123H reverted from H123Y) mutations (TadA*8.23). In some embodiments, the ABE8 is ABE8.24-7, which has a heterodimeric construct containing TadA*7.10 fused to TadA*7.10 with V82S, Y123H (Y123H reverted from H123Y), and Y147T mutations (TadA*8.24

In some embodiments, the ABE is ABE8.1-m, ABE8.2-m, ABE8.3-m, ABE8.4-m, ABE8.5-m, ABE8.6-m, ABE8.7-m, ABE8.8-m, ABE8.9-m, ABE8.10-m, ABE8.11-m, ABE8.12-m, ABE8.13-m, ABE8.14-m, ABE8.15-m, ABE8.16-m, ABE8.17-m, ABE8.18-m, ABE8.19-m, ABE8.20-m, ABE8.21-m, ABE8.22-m, ABE8.23-m, ABE8.24-m, ABE8.1-d, ABE8.2-d, ABE8.3-d, ABE8.4-d, ABE8.5-d, ABE8.6-d, ABE8.7-d, ABE8.8-d, ABE8.9-d, ABE8.10-d, ABE8.11-d, ABE8.12-d, ABE8.13-d, ABE8.14-d, ABE8.15-d, ABE8.16-d, ABE8.17-d, ABE8.18-d, ABE8.19-d, ABE8.20-d, ABE8.21-d, ABE8.22-d, ABE8.23-d, or ABE8.24-d as shown in Table 7 below.

TABLE 7

| Base Editors - ABE8s | | |
| --- | --- | --- |
| ABE8 Name | Adenosine Deaminase | Adenosine Deaminase Description |
| ABE8.1-m | TadA*8.1 | Monomer_TadA*7.10 + Y147T |
| ABE8.2-m | TadA*8.2 | Monomer_TadA*7.10 + Y147R |

TABLE 7-continued

Base Editors - ABE8s

| ABE8 Name | Adenosine Deaminase | Adenosine Deaminase Description |
|---|---|---|
| ABE8.3-m | TadA*8.3 | Monomer_TadA*7.10 + Q154S |
| ABE8.4-m | TadA*8.4 | Monomer_TadA*7.10 + Y123H |
| ABE8.5-m | TadA*8.5 | Monomer_TadA*7.10 + V82S |
| ABE8.6-m | TadA*8.6 | Monomer_TadA*7.10 + T166R |
| ABE8.7-m | TadA*8.7 | Monomer_TadA*7.10 + Q154R |
| ABE8.8-m | TadA*8.8 | Monomer_TadA*7.10 + Y147R_Q154R_Y123H |
| ABE8.9-m | TadA*8.9 | Monomer_TadA*7.10 + Y147R_Q154R_I76Y |
| ABE8.10-m | TadA*8.10 | Monomer_TadA*7.10 + Y147R_Q154R_T166R |
| ABE8.11-m | TadA*8.11 | Monomer_TadA*7.10 + Y147T_Q154R |
| ABE8.12-m | TadA*8.12 | Monomer_TadA*7.10 + Y147T_Q154S |
| ABE8.13-m | TadA*8.13 | Monomer_TadA*7.10 + Y123H_Y147R_Q154R_I76Y |
| ABE8.14-m | TadA*8.14 | Monomer_TadA*7.10 + I76Y_V82S |
| ABE8.15-m | TadA*8.15 | Monomer_TadA*7.10 + V82S_Y147R |
| ABE8.16-m | TadA*8.16 | Monomer_TadA*7.10 + V82S_Y123H_Y147R |
| ABE8.17-m | TadA*8.17 | Monomer_TadA*7.10 + V82S_Q154R |
| ABE8.18-m | TadA*8.18 | Monomer_TadA*7.10 + V82S_Y123H_Q154R |
| ABE8.19-m | TadA*8.19 | Monomer_TadA*7.10 + V82S_Y123H_Y147R_Q154R |
| ABE8.20-m | TadA*8.20 | Monomer_TadA*7.10 + I76Y_V82S_Y123H_Y147R_Q154R |
| ABE8.21-m | TadA*8.21 | Monomer_TadA*7.10 + Y147R_Q154S |
| ABE8.22-m | TadA*8.22 | Monomer_TadA*7.10 + V82S_Q154S |
| ABE8.23-m | TadA*8.23 | Monomer_TadA*7.10 + V82S_Y123H |
| ABE8.24-m | TadA*8.24 | Monomer_TadA*7.10 + V82S_Y123H_Y147T |
| ABE8.1-d | TadA*8.1 | Heterodimer_(WT) + (TadA*7.10 + Y147T) |
| ABE8.2-d | TadA*8.2 | Heterodimer_(WT) + (TadA*7.10 + Y147R) |
| ABE8.3-d | TadA*8.3 | Heterodimer_(WT) + (TadA*7.10 + Q154S) |
| ABE8.4-d | TadA*8.4 | Heterodimer_(WT) + (TadA*7.10 + Y123H) |
| ABE8.5-d | TadA*8.5 | Heterodimer_(WT) + (TadA*7.10 + V82S) |
| ABE8.6-d | TadA*8.6 | Heterodimer_(WT) + (TadA*7.10 + T166R) |
| ABE8.7-d | TadA*8.7 | Heterodimer_(WT) + (TadA*7.10 + Q154R) |
| ABE8.8-d | TadA*8.8 | Heterodimer_(WT) + (TadA*7.10 + Y147R_Q154R_Y123H) |
| ABE8.9-d | TadA*8.9 | Heterodimer_(WT) + (TadA*7.10 + Y147R_Q154R_I76Y) |
| ABE8.10-d | TadA*8.10 | Heterodimer_(WT) + (TadA*7.10 + Y147R_Q154R_T166R) |
| ABE8.11-d | TadA*8.11 | Heterodimer_(WT) + (TadA*7.10 + Y147T_Q154R) |
| ABE8.12-d | TadA*8.12 | Heterodimer_(WT) + (TadA*7.10 + Y147T_Q154S) |
| ABE8.13-d | TadA*8.13 | Heterodimer_(WT) + (TadA*7.10 + Y123H_Y147T_Q154R_I76Y) |
| ABE8.14-d | TadA*8.14 | Heterodimer_(WT) + (TadA*7.10 + I76Y_V82S) |
| ABE8.15-d | TadA*8.15 | Heterodimer_(WT) + (TadA*7.10 + V82S_Y147R) |
| ABE8.16-d | TadA*8.16 | Heterodimer_(WT) + (TadA*7.10 + V82S_Y123H_Y147R) |
| ABE8.17-d | TadA*8.17 | Heterodimer_(WT) + (TadA*7.10 + V82S_Q154R) |
| ABE8.18-d | TadA*8.18 | Heterodimer_(WT) + (TadA*7.10 + V82S_Y123H_Q154R) |
| ABE8.19-d | TadA*8.19 | Heterodimer_(WT) + (TadA*7.10 + V82S_Y123H_Y147R_Q154R) |
| ABE8.20-d | TadA*8.20 | Heterodimer_(WT) + (TadA*7.10 + I76Y_V82S_Y123H_Y147R_Q154R) |
| ABE8.21-d | TadA*8.21 | Heterodimer_(WT) + (TadA*7.10 + Y147R_Q154S) |
| ABE8.22-d | TadA*8.22 | Heterodimer_(WT) + (TadA*7.10 + V82S_Q154S) |
| ABE8.23-d | TadA*8.23 | Heterodimer_(WT) + (TadA*7.10 + V82S_Y123H) |
| ABE8.24-d | TadA*8.24 | Heterodimer_(WT) + (TadA*7.10 + V82S_Y123H_Y147T) |

In some embodiments, base editors (e.g., ABE8) are generated by cloning an adenosine deaminase variant (e.g., TadA*8) into a scaffold that includes a circular permutant Cas9 (e.g., CP5 or CP6) and a bipartite nuclear localization sequence. In some embodiments, the base editor (e.g., ABE7.9, ABE7.10, or ABE8) is an NGC PAM CP5 variant (*S. pyrogenes* Cas9 or spVRQR Cas9). In some embodiments, the base editor (e.g., ABE7.9, ABE7.10, or ABE8) is an AGA PAM CP5 variant (*S. pyrogenes* Cas9 or spVRQR Cas9). In some embodiments, the base editor (e.g., ABE7.9, ABE7.10, or ABE8) is an NGC PAM CP6 variant (*S. pyrogenes* Cas9 or spVRQR Cas9). In some embodiments, the base editor (e.g. ABE7.9, ABE7.10, or ABE8) is an AGA PAM CP6 variant (*S. pyrogenes* Cas9 or spVRQR Cas9).

In some embodiments, the ABE has a genotype as shown in Table 8 below.

TABLE 8

Genotypes of ABEs

| | 23 | 26 | 36 | 37 | 48 | 49 | 51 | 72 | 84 | 87 | 105 | 108 | 123 | 125 | 142 | 145 | 147 | 152 | 155 | 156 | 157 | 161 |
|---|---|---|---|---|---|---|---|---|---|---|---|---|---|---|---|---|---|---|---|---|---|---|
| ABE7.9 | L | R | L | N | A | | L | N | F | S | V | N | Y | G | N | C | Y | P | V | F | N | K |
| ABE7.10 | R | R | L | N | A | | L | N | F | S | V | N | Y | G | A | C | Y | P | V | F | N | K |

As shown in Table 9 below, genotypes of 40 ABE8s are described. Residue positions in the evolved *E. coli* TadA portion of ABE are indicated. Mutational changes in ABE8 are shown when distinct from ABE7.10 mutations. In some embodiments, the ABE has a genotype of one of the ABEs presented in Table 9 below.

TABLE 9

| | | | | | | | | | Residue Identity in Evolved TadA | | | | | | | | | |
|---|---|---|---|---|---|---|---|---|---|---|---|---|---|---|---|---|---|---|
| | 23 | 36 | 48 | 51 | 76 | 82 | 84 | 106 | 108 | 123 | 146 | 147 | 152 | 154 | 155 | 156 | 157 | 166 |
| ABE7.10 | R | L | A | L | I | V | F | V | N | Y | C | Y | P | Q | V | F | N | T |
| ABE8.1-m | | | | | | | | | | | | T | | | | | | |
| ABE8.2-m | | | | | | | | | | | | R | | | | | | |
| ABE8.3-m | | | | | | | | | | | | | | S | | | | |
| ABE8.4-m | | | | | | | | | | H | | | | | | | | |
| ABE8.5-m | | | | | | S | | | | | | | | | | | | |
| ABE8.6-m | | | | | | | | | | | | | | | | | | R |
| ABE8.7-m | | | | | | | | | | | | | | R | | | | |
| ABE8.8-m | | | | | | | | | | H | | R | | R | | | | |
| ABE8.9-m | | Y | | | | | | | | | | R | | R | | | | |
| ABE8.10-m | | | | | | | | | | | | R | | R | | | R | |
| ABE8.11-m | | | | | | | | | | | | T | | R | | | | |
| ABE8.12-m | | | | | | | | | | | | T | | S | | | | |
| ABE8.13-m | | Y | | | | | | | | H | | R | | R | | | | |
| ABE8.14-m | | Y | S | | | | | | | | | | | | | | | |
| ABE8.15-m | | | S | | | | | | | | | R | | | | | | |
| ABE8.16-m | | | S | | | | | | | H | | R | | | | | | |
| ABE8.17-m | | | S | | | | | | | | | | | R | | | | |
| ABE8.18-m | | | S | | | | | | | H | | | | R | | | | |
| ABE8.19-m | | | S | | | | | | | H | | R | | R | | | | |
| ABE8.20-m | | Y | S | | | | | | | H | | R | | R | | | | |
| ABE8.21-m | | | | | | | | | | | | R | | S | | | | |
| ABE8.22-m | | | S | | | | | | | | | | | S | | | | |
| ABE8.23-m | | | S | | | | | | | H | | | | | | | | |
| ABE8.24-m | | | S | | | | | | | H | | T | | | | | | |
| ABE8.1-d | | | | | | | | | | | | T | | | | | | |
| ABE8.2-d | | | | | | | | | | | | R | | | | | | |
| ABE8.3-d | | | | | | | | | | | | | | S | | | | |
| ABE8.4-d | | | | | | | | | | H | | | | | | | | |
| ABE8.5-d | | | | | | S | | | | | | | | | | | | |
| ABE8.6-d | | | | | | | | | | | | | | | | | | R |
| ABE8.7-d | | | | | | | | | | | | | | R | | | | |
| ABE8.8-d | | | | | | | | | | H | | R | | R | | | | |
| ABE8.9-d | | Y | | | | | | | | | | R | | R | | | | |
| ABE8.10-d | | | | | | | | | | | | R | | R | | | R | |
| ABE8.11-d | | | | | | | | | | | | T | | R | | | | |
| ABE8.12-d | | | | | | | | | | | | T | | S | | | | |
| ABE8.13-d | | Y | | | | | | | | H | | R | | R | | | | |
| ABE8.14-d | | Y | S | | | | | | | | | | | | | | | |
| ABE8.15-d | | | S | | | | | | | | | R | | | | | | |
| ABE8.16-d | | | S | | | | | | | H | | R | | | | | | |
| ABE8.17-d | | | S | | | | | | | | | | | R | | | | |
| ABE8.18-d | | | S | | | | | | | H | | | | R | | | | |
| ABE8.19-d | | | S | | | | | | | H | | R | | R | | | | |
| ABE8.20-d | | Y | S | | | | | | | H | | R | | R | | | | |
| ABE8.21-d | | | | | | | | | | | | R | | S | | | | |
| ABE8.22-d | | | S | | | | | | | | | | | S | | | | |
| ABE8.23-d | | | S | | | | | | | H | | | | | | | | |
| ABE8.24-d | | | S | | | | | | | H | | T | | | | | | |

In some embodiments, the base editor is ABE8.1, which comprises or consists essentially of the following sequence or a fragment thereof having adenosine deaminase activity:

ABE8.1_Y147T_CP5_NGC PAM_monomer
(SEQ ID NO: 105)
MSEVEFSHEYWMRHALTLAKRARDEREVPVGAVLVLNNRVIGEGWNRAIG

LHDPTAHAEIMALRQGGLVMQNYRLIDATLYVTFEPCVMCAGAMIHSRIG

RVVFGVRNAKTGAAGSLMDVLHYPGMNHRVEITEGILADECAALLCTFFR

MPRQVFNAQKKAQSSTD*SGGSSGGSSGSETPGTSESATPESSGGSSGGS*E

IGKATAKYFFYSNIMNFFKTEITLANGEIRKRPLIETNGETGEIVWDKGR

DFATVRKVLSMPQVNIVKKTEVQTGGFSKESILPKRNSDKLIARKKDWDP

KKYGGFMQPTVAYSVLVVAKVEKGKSKKLKSVKELLGITIMERSSFEKNP

IDFLEAKGYKEVKKDLIIKLPKYSLFELENGRKRMLASAKFLQKGNELAL

PSKYVNFLYLASHYEKLKGSPEDNEQKQLFVEQHKHYLDEIIEQISEFSK

RVILADANLDKVLSAYNKHRDKPIREQAENIIHLFTLTNLGAPRAFKYFD

TTIARKEYRSTKEVLDATLIHQSITGLYETRIDLSQLGGD

*GGSGGSGGSGGSGGSGGSGG*MDKKYSIGLAIGTNSVGWAVITDEYKVPSK

KFKVLGNTDRHSIKKNLIGALLFDSGETAEATRLKRTARRRYTRRKNRIC

YLQEIFSNEMAKVDDSFFHRLEESFLVEEDKKHERHPIFGNIVDEVAYHE

KYPTIYHLRKKLVDSTDKADLRLIYLALAHMIKFRGHFLIEGDLNPDNSD

VDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLA

QIGDQYADLFLAAKYLSDAILLSDILRVNTEITKAPLSASMIKRYDEHHQ

DLTLLKALVRQQLPEKYKEIFFDQSIMGYAGYIDGGASQEEFYKFIKPIL

EKMDGTEELLVKLNREDLLRKQRTFDNGSIPHQIHLGELHAILRRQEDFY
PFLKDNREKIEKILTFRIPYYVGPLARGNSRFAWMTRKSEETITPWNFEE
VVDKGASAQSFIERMTNFDIMLPNEKVLPKHSLLYEYFTVYNELTKVKYV
TEGMRKPAFLSGEQKKAIVDLLFKTNRKVTVKQLKEDYFKKIECFDSVEI
SGVEDRFNASLGTYHDLLKIIKDKDFLDNEENEDILEDIVLTLTLFEDRE
MIEERLKTYAHLFDDKVMKQLKRRRYTGWGRLSRKLINGIRDKQSGKTIL
DFLKSDGFANRNFMQLIHDDSLTFKEDIQKAQVSGQGDSLHEHIANLAGS
PAIKKGILQTVKVVDELVKVMGRHKPENIVIEMARENQTTQKGQKNSRER
MKRIEEGIKELGSQILKEHPVENTQLQNEKLYLYYLQNGRDMYVDQELDI
NRLSDYDVDHIVPQSFLKDDSIDNKVLTRSDKNRGKSDNVPSEEVVKKMK
NYWRQLLNAKLITQRKFDNLTKAERGGLSELDKAGFIKRQLVETRQITKH
VAQILDSRMNTKYDENDKLIREVKVITLKSKLVSDFRKDFQFYKVREINN
YHHAHDAYLNAVVGTALIKKYPKLESEFVYGDYKVYDVRKMIAKSEQ*EGA*
*DKRTADGSEFESPKKKRKV**

In the above sequence, the plain text denotes an adenosine deaminase sequence, bold sequence indicates sequence derived from Cas9, the italics sequence denotes a linker sequence, and the underlined sequence denotes a bipartite nuclear localization sequence.

In some embodiments, the base editor is ABE8.1, which comprises or consists essentially of the following sequence or a fragment thereof having adenosine deaminase activity:

```
pNMG-B335 ABE8.1_Y147T_CP5_NGC PAM_monomer
                                  (SEQ ID NO: 105)
MSEVEFSHEYWMRHALTLAKRARDEREVPVGAVLVLNNRVIGEGWNRAIGL
HDPTAHAEIMALRQGGLVMQNYRLIDATLYVTFEPCVMCAGAMIHSRIGRV
VFGVRNAKTGAAGSLMDVLHYPGMNHRVEITEGILADECAALLCTFFRMPR
QVFNAQKKAQSSTDSGGSSGGSSGSETPGTSESATPESSGGSSGGS
```
EIGKA
TAKYFFYSNIMNFFKTEITLANGEIRKRPLIETNGETGEIVWDKGRDFATV
RKVLSMPQVNIVKKTEVQTGGFSKESILPKRNSDKLIARKKDWDPKKYGGF
MQPTVAYSVLVVAKVEKGKSKKLKSVKELLGITIMERSSFEKNPIDFLEAK
GYKEVKKDLIIKLPKYSLFELENGRKRMLASAKFLQKGNELALPSKYVNFL
YLASHYEKLKGSPEDNEQKQLFVEQHKHYLDEIIEQISEFSKRVILADANL
DKVLSAYNKHRDKPIREQAENIIHLFTLTNLGAPRAFKYFDTTIARKEYRS
TKEVLDATLIHQSITGLYETRIDLSQLGGD*GGSGGSGGSGGSGGSGGSGGM*
DKKYSIGLAIGTNSVGWAVITDEYKVPSKKFKVLGNTDRHSIKKNLIGALL
FDSGETAEATRLKRTARRRYTRRKNRICYLQEIFSNEMAKVDDSFFHRLEE
SFLVEEDKKHERHPIFGNIVDEVAYHEKYPTIYHLRKKLVDSTDKADLRLI
YLALAHMIKFRGHFLIEGDLNPDNSDVDKLFIQLVQTYNQLFEENPINASG
VDAKAILSARLSKSRRLENLIAQLPGEKKNGLFGNLIALSLGLTPNFKSNF
DLAEDAKLQLSKDTYDDDLDNLLAQIGDQYADLFLAAKNLSDAILLSDILR
VNTEITKAPLSASMIKRYDEHHQDLTLLKALVRQQLPEKYKEIFFDQSKNG
YAGYIDGGASQEEFYKFIKPILEKMDGTEELLVKLNREDLLRKQRTFDNGS
IPHQIHLGELHAILRRQEDFYPFLKDNREKIEKILTFRIPYYVGPLARGNS
RFAWMTRKSEETITPWNFEEVVDKGASAQSFIERMTNFDKNLPNEKVLPKH
SLLYEYFTVYNELTKVKYVTEGMRKPAFLSGEQKKAIVDLLFKTNRKVTVK
QLKEDYFKKIECFDSVEISGVEDRFNASLGTYHDLLKIIKDKDFLDNEENE
DILEDIVLTLTLFEDREMIEERLKTYAHLFDDKVMKQLKRRRYTGWGRLSR
KLINGIRDKQSGKTILDFLKSDGFANRNFMQLIHDDSLTFKEDIQKAQVSG
QGDSLHEHIANLAGSPAIKKGILQTVKVVDELVKVMGRHKPENIVIEMARE
NQTTQKGQKNSRERMKRIEEGIKELGSQILKEHPVENTQLQNEKLYLYYLQ
NGRDMYVDQELDINRLSDYDVDHIVPQSFLKDDSIDNKVLTRSDKNRGKSD
NVPSEEVVKKMKNYWRQLLNAKLITQRKFDNLTKAERGGLSELDKAGFIKR
QLVETRQITKHVAQILDSRMNTKYDENDKLIREVKVITLKSKLVSDFRKDF
QFYKVREINNYHHAHDAYLNAVVGTALIKKYPKLESEFVYGDYKVYDVRKM
IAKSEQ*EGADKRTADGSEFESPKKKRKV**

In the above sequence, the plain text denotes an adenosine deaminase sequence, bold sequence indicates sequence derived from Cas9, the italics sequence denotes a linker sequence, and the underlined sequence denotes a bipartite nuclear localization sequence.

In some embodiments, the base editor is ABE8.14, which comprises or consists essentially of the following sequence or a fragment thereof having adenosine deaminase activity:

```
pNMG-357_ABE8.14 with NGC PAM CP5
                                  (SEQ ID NO: 106)
MSEVEFSHEYWMRHALTLAKRAWDEREVPVGAVLVHNNRVIGEGWNRPIGR
HDPTAHAEIMALRQGGLVMQNYRLIDATLYVTLEPCVMCAGAMIHSRIGRV
VFGARDAKTGAAGSLMDVLHHPGMNHRVEITEGILADECAALLSDFFRMRR
QEIKAQKKAQSSTDGGSSGGSSGSETPGTSESATPESSGGSSGGSMSEVEF
```
SHEYWMRHALTLAKRARDEREVPVGAVLVLNNRVIGEGWNRAIGLHDPTAH
AEIMALRQGGLVMQNYRLIDATLYVTFEPCVMCAGAMIHSRIGRVVFGVRN
AKTGAAGSLMDVLHYPGMNHRVEITEGILADECAALLCTFFRMPRQVFNAQ
KKAQSSTD*SGGSSGGSSGSETPGTSESATPESSGGSSGGS*EIGKATAKYFF
YSNIMNFFKTEITLANGEIRKRPLIETNGETGEIVWDKGRDFATVRKVLSM
PQVNIVKKTEVQTGGFSKESILPKRNSDKLIARKKDWDPKKYGGFMQPTVA
YSVLVVAKVEKGKSKKLKSVKELLGITIMERSSFEKNPIDFLEAKGYKEVK
KDLIIKLPKYSLFELENGRKRMLASAKFLQKGNELALPSKYVNFLYLASHY
EKLKGSPEDNEQKQLFVEQHKHYLDEIIEQISEFSKRVILADANLDKVLSA
YNKHRDKPIREQAENIIHLFTLTNLGAPRAFKYFDTTIARKEYRSTKEVLD
ATLIHQSITGLYETRIDLSQLGGD*GGSGGSGGSGGSGGSGGSGGM*DKKYSI
GLAIGTNSVGWAVITDEYKVPSKKFKVLGNTDRHSIKKNLIGALLFDSGET
AEATRLKRTARRRYTRRKNRICYLQEIFSNEMAKVDDSFFHRLEESFLVEE
DKKHERHPIFGNIVDEVAYHEKYPTIYHLRKKLVDSTDKADLRLIYLALAH
MIKFRGHFLIEGDLNPDNSDVDKLFIQLVQTYNQLFEENPINASGVDAKAI
LSARLSKSRRLENLIAQLPGEKKNGLFGNLIALSLGLTPNFKSNFDLAEDA
KLQLSKDTYDDDLDNLLAQIGDQYADLFLAAKNLSDAILLSDILRVNTEIT -continued

KAPLSASMIKRYDEHHQDLTLLKALVRQQLPEKYKEIFFDQSKNGYAGYID

GGASQEEFYKFIKPILEKMDGTEELLVKLNREDLLRKQRTFDNGSIPHQIH

LGELHAILRRQEDFYPFLKDNREKIEKILTFRIPYYVGPLARGNSRFAWMT

RKSEETITPWNFEEVVDKGASAQSFIERMTNFDKNLPNEKVLPKHSLLYEY

FTVYNELTKVKYVTEGMRKPAFLSGEQKKAIVDLLFKTNRKVTVKQLKEDY

FKKIECFDSVEISGVEDRFNASLGTYHDLLKIIKDKDFLDNEENEDILEDI

VLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLH

EHIANLAGSPAIKKGILQTVKVVDELVKVMGRHKPENIVIEMARENQTTQK

GQKNSRERMKRIEEGIKELGSQILKEHPVENTQLQNEKLYLYYLQNGRDMY

VDQELDINRLSDYDVDHIVPQSFLKDDSIDNKVLTRSDKNRGKSDNVPSEE

VVKKMKNYWRQLLNAKLITQRKFDNLTKAERGGLSELDKAGFIKRQLVETR

QITKHVAQILDSRMNTKYDENDKLIREVKVITLKSKLVSDFRKDFQFYKVR

EINNYHHAHDAYLNAVVGTALIKKYPKLESEFVYGDYKVYDVRKMIAKSEQ

EGADKRTADGSEFESPKKKRKV*

In the above sequence, the plain text denotes an adenosine deaminase sequence, bold sequence indicates sequence derived from Cas9, the italics sequence denotes a linker sequence, and the underlined sequence denotes a bipartite nuclear localization sequence.

In some embodiments, the base editor is ABE8.8-m, which comprises or consists essentially of the following sequence or a fragment thereof having adenosine deaminase activity:

ABE8.8-m
(SEQ ID NO: 107)
MSEVEFSHEYWMRHALTLAKRARDEREVPVGAVLVLNNRVIGEGWNRAIGL

HDPTAHAEIMALRQGGLVMQNYRLIDATLYVTFEPCVMCAGAMIHSRIGRV

VFGVRNAKTGAAGSLMDVLHHPGMNHRVEITEGILADECAALLCRFFRMPR

RVFNAQKKAQSSTDSGGSSGGSSGSETPGTSESATPESSGGSSGGSDKKYS

IGLAIGTNSVGWAVITDEYKVPSKKFKVLGNTDRHSIKKNLIGALLFDSGE

TAEATRLKRTARRRYTRRKNRICYLQEIFSNEMAKVDDSFFHRLEESFLVE

EDKKHERHPIFGNIVDEVAYHEKYPTIYHLRKKLVDSTDKADLRLIYLALA

HMIKFRGHFLIEGDLNPDNSDVDKLFIQLVQTYNQLFEENPINASGVDAKA

ILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYI

DGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWM

TRKSEETITPWNFEEVVDKGASAQSFIERMTNFDKNLPNEKVLPKHSLLYE

YFTVYNELTKVKYVTEGMRKPAFLSGEQKKAIVDLLFKTNRKVTVKQLKED

YFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLING

IRDKQSGKTILDFLKSDGFANRNFMQLIHDDSLTFKEDIQKAQVSGQGDSL

-continued

HEHIANLAGSPAIKKGILQTVKVVDELVKVMGRHKPENIVIEMARENQTTQ

KGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSE

EVVKKMKNYWRQLLNAKLITQRKFDNLTKAERGGLSELDKAGFIKRQLVET

RQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSE

QEIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTID

RKRYTSTKEVLDATLIHQSITGLYETRIDLSQLGGDEGADKRTADGSEFES

PKKKRKV*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.8-d, which comprises or consists essentially of the following sequence or a fragment thereof having adenosine deaminase activity:

ABE8.8-d
(SEQ ID NO: 108)
MSEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGRV

VFGARDAKTGAAGSLMDVLHHPGMNHRVEITEGILADECAALLSDFFRMRR

QEIKAQKKAQSSTDSGGSSGGSSGSETPGTSESATPESSGGSSGGSSEVEF

SHEYWMRHALTLAKRARDEREVPVGAVLVLNNRVIGEGWNRAIGLHDPTAH

AEIMALRQGGLVMQNYRLIDATLYVTFEPCVMCAGAMIHSRIGRVVFGVRN

AKTGAAGSLMDVLHHPGMNHRVEITEGILADECAALLCRFFRMPRRVFNAQ

KKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATR

LKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFR

GHFLIEGDLNPDNSDVDKLFIQLVQTYNQLFEENPINASGVDAKAILSARL

SKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLS

ASMIKRYDEHHQDLTLLKALVRQQLPEKYKEIFFDQSKNGYAGYIDGGASQ

EEFYKFIKPILEKMDGTEELLVKLNREDLLRKQRTFDNGSIPHQIHLGELH

AILRRQEDFYPFLKDNREKIEKILTFRIPYYVGPLARGNSRFAWMTRKSEE

TITPWNFEEVVDKGASAQSFIERMTNFDKNLPNEKVLPKHSLLYEYFTVYN

ELTKVKYVTEGMRKPAFLSGEQKKAIVDLLFKTNRKVTVKQLKEDYFKKIE

-continued

CFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQS

GKTILDFLKSDGFANRNFMQLIHDDSLTFKEDIQKAQVSGQGDSLHEHIAN

LAGSPAIKKGILQTVKVVDELVKVMGRHKPENIVIEMARENQTTQKGQKNS

RERMKRIEEGIKELGSQILKEHPVENTQLQNEKLYLYYLQNGRDMYVDQEL

DINRLSDYDVDHIVPQSFLKDDSIDNKVLTRSDKNRGKSDNVPSEEVVKKM

KNYWRQLLNAKLITQRKFDNLTKAERGGLSELDKAGFIKRQLVETRQITKH

VAQILDSRMNTKYDENDKLIREVKVITLKSKLVSDFRKDFQFYKVREINNY

HHAHDAYLNAVVGTALIKKYPKLESEFVYGDYKVYDVRKMIAKSEQEIGKA

TAKYFFYSNIMNFFKTEITLANGEIRKRPLIETNGETGEIVWDKGRDFATV

RKVLSMPQVNIVKKTEVQTGGFSKESILPKRNSDKLIARKKDWDPKKYGGF

DSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFL

YLASHYEKLKGSPEDNEQKQLFVEQHKHYLDEIIEQISEFSKRVILADANL

DKVLSAYNKHRDKPIREQAENIIHLFTLTNLGAPAAFKYFDTTIDRKRYTS

TKEVLDATLIHQSITGLYETRIDLSQLGGD<u>EGADKRTADGSEFESPKKKRK</u>

<u>V</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-m, which comprises or consists essentially of the following sequence or a fragment thereof having adenosine deaminase activity:

ABE8.13-m
(SEQ ID NO: 109)
MSEVEFSHEYWMRHALTLAKRARDEREVPVGAVLVLNNRVIGEGWNRAIGL

HDPTAHAEIMALRQGGLVMQNYRLYDATLYVTFEPCVMCAGAMIHSRIGRV

VFGVRNAKTGAAGSLMDVLHHPGMNHRVEITEGILADECAALLCRFFRMPR

RVFNAQKKAQSSTD*SGGSSGGSSGSETPGTSESATPESSGGSSGGS*DKKYS

IGLA̲IGTNSVGWAVITDEYKVPSKKFEWLGNTDRHSIKKNLIGALLFDSGE

TAEATRLKRTARRRYTRRKNRICYLQEIFSNEMAKVDDSFFHRLEESFLVE

-continued

EDKKHERHPIFGNIVDEVAYHEKYPTIYHLRKKLVDSTDKADLRLIYLALA

HMIKFRGHFLIEGDLNPDNSDVDKLFIQLVQTYNQLFEENPINASGVDAKA

ILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYI

DGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWM

TRKSEETITPWNFEEVVDKGASAQSFIERMTNFDKNLPNEKVLPKHSLLYE

YFTVYNELTKVKYVTEGMRKPAFLSGEQKKAIVDLLFKTNRKVTVKQLKED

YFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLING

IRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQ

KGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSE

EVVKKMKNYWRQLLNAKLITQRKFDNLTKAERGGLSELDKAGFIKRQLVET

RQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSE

QEIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTID

RKRYTSTKEVLDATLIHQSITGLYETRIDLSQLGGD<u>EGADKRTADGSEFES</u>

<u>PKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.13-d, which comprises or consists essentially of the following sequence or a fragment thereof having adenosine deaminase activity:

ABE8.13-d
(SEQ ID NO: 110)
MSEVEFSHEYWMRHALTLAKRAWDEREVPVGAVLVHNNRVIGEGWNRPIGRHDPTAHAEIMALRQGGLVM

QNYRLIDATLYVTLEPCVMCAGAMIHSRIGRVVFGARDAKTGAAGSLMDVLHHPGMNHRVEITEGILADE

CAALLSDFFRMRRQEIKAQKKAQSSTD*SGGSSGGSSGSETPGTSESATPESSGGSSGGSS*EVEFSHEYWM

RHALTLAKRARDEREVPVGAVLVLNNRVIGEGWNRAIGLHDPTAHAEIMALRQGGLVMQNYRLYDATLYV

TFEPCVMCAGAMIHSRIGRVVFGVRNAKTGAAGSLMDVLHHPGMNHRVEITEGILADECAALLCRFFRMP

RRVFNAQKKAQSSTD*SGGSSGGSSGSETPGTSESATPESSGGSSGGS*DKKYSIGLA̲IGTNSVGWAVITDE

YKVPSKKFKVLGNTDRHSIKKNLIGALLFDSGETAEATRLKRTARRRYTRRKNRICYLQEIFSNEMAKVD

```
DSFFHRLEESFLVEEDKKHERHPIFGNIVDEVAYHEKYPTIYHLRKKLVDSTDKADLRLIYLALAHMIKF

RGHFLIEGDLNPDNSDVDKLFIQLVQTYNQLFEENPINASGVDAKAILSARLSKSRRLENLIAQLPGEKK

NGLFGNLIALSLGLTPNFKSNFDLAEDAKLQLSKDTYDDDLDNLLAQIGDQYADLFLAAKNLSDAILLSD

ILRVNTEITKAPLSASMIKRYDEHHQDLTLLKALVRQQLPEKYKEIFFDQSKNGYAGYIDGGASQEEFYK

FIKPILEKMDGTEELLVKLNREDLLRKQRTFDNGSIPHQIHLGELHAILRRQEDFYPFLKDNREKIEKIL

TFRIPYYVGPLARGNSRFAWMTRKSEETITPWNFEEVVDKGASAQSFIERMTNFDKNLPNEKVLPKHSLL

YEYFTVYNELTKVKYVTEGMRKPAFLSGEQKKAIVDLLFKTNRKVTVKQLKEDYFKKIECFDSVEISGVE

DRFNASLGTYHDLLKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKAQVSGQGDSLHEHI

ANLAGSPAIKKGILQTVKVVDELVKVMGRHKPENIVIEMARENQTTQKGQKNSRERMKRIEEGIKELGSQ

ILKEHPVENTQLQNEKLYLYYLQNGRDMYVDQELDINRLSDYDVDHIVPQSFLKDDSIDNKVLTRSDKNR

GKSDNVPSEEVVKKMKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYLNAVVGTALIKKYPKL

ESEFVYGDYKVYDVRKMIAKSEQEIGKATAKYFFYSNIMNFFKTEITLANGEIRKRPLIETNGETGEIVW

DKGRDFATVRKVLSMPQVNIVKKTEVQTGGFSKESILPKRNSDKLIARKKDWDPKKYGGFDSPTVAYSVL

VVAKVEKGKSKKLKSVKELLGITIMERSSFEKNPIDFLEAKGYKEVKKDLIIKLPKYSLFELENGRKRML

ASAGELQKGNELALPSKYVNFLYLASHYEKLKGSPEDNEQKQLFVEQHKHYLDEIIEQISEFSKRVILAD

ANLDKVLSAYNKHRDKPIREQAENIIHLFTLTNLGAPAAFKYFDTTIDRKRYTSTKEVLDATLIHQSITG

LYETRIDLSQLGGD*EGADKRTADGSEFESPKKKRKV**
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-m, which comprises or consists essentially of the following sequence or a fragment thereof having adenosine deaminase activity:

```
ABE8.17-m
                                        (SEQ ID NO: 111)
MSEVEFSHEYWMRHALTLAKRARDEREVPVGAVLVLNNRVIGEGWNRAIGL

HDPTAHAEIMALRQGGLVMQNYRLIDATLYSTFEPCVMCAGAMIHSRIGRV

VFGVRNAKTGAAGSLMDVLHYPGMNHRVEITEGILADECAALLCYFFRMPR

RVFNAQKKAQSSTDSGGSSGGSSGSETPGTSESATPESSGGSSGGSDKKYS

IGLAIGTNSVGWAVITDEYKVPSKKFKVLGNTDRHSIKKNLIGALLFDSGE

TAEATRLKRTARRRYTRRKNRICYLQEIFSNEMAKVDDSFFHRLEESFLVE

EDKKHERHPIFGNIVDEVAYHEKYPTIYHLRKKLVDSTDKADLRLIYLALA

HMIKFRGHFLIEGDLNPDNSDVDKLFIQLVQTYNQLFEENPINASGVDAKA

ILSARLSKSRRLENLIAQLPGEKKNGLFGNLIALSLGLTPNFKSNFDLAED

AKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYI

DGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWM

TRKSEETITPWNFEEVVDKGASAQSFIERMTNFDKNLPNEKVLPKHSLLYE

YFTVYNELTKVKYVTEGMRKPAFLSGEQKKAIVDLLFKTNRKVTVKQLKED

YFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLING

IRDKQSGKTILDFLKSDGFANRNFMQLIHDDSLTFKEDIQKAQVSGQGDSL

HEHIANLAGSPAIKKGILQTVKVVDELVKVMGRHKPENIVIEMARENQTTQ

KGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSE

EVVKKMKNYWRQLLNAKLITQRKFDNLTKAERGGLSELDKAGFIKRQLVET

RQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSE

QEIGKATAKYFFYSNIMNFFKTEITLANGEIRKRPLIETNGETGEIVWDKG

RDFATVRKVLSMPQVNIVKKTEVQTGGFSKESILPKRNSDKLIARKEDWDP

KKYGGFDSPTVAYSVLVVAKVEKGKSKKLKSVKELLGITIMERSSFEKNPI

DFLEAKGYKEVERDLIIKLPKYSLFELENGRKRMLASAGELQKGNELALPS

KYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTID

RKRYTSTKEVLDATLIHQSITGLYETRIDLSQLGGDEGADKRTADGSEFES

PKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.17-d, which comprises or consists essentially of the following sequence or a fragment thereof having adenosine deaminase activity:

ABE8.17-d (SEQ ID NO: 112)

MSEVEFSHEYWMRHALTLAKRAWDEREVPVGAVLVHNNRVIGEGWNRPIGRHDPTAHAEIMALR

QGGLVMQNYRLIDATLYVTLEPCVMCAGAMIHSRIGRVVFGARDAKTGAAGSLMDVLHHPGMNH

RVEITEGILADECAALLSDFFRMRRQEIKAQKKAQSSTD*SGGSSGGSSGSETPGTSESATPESS*

*GGSSGGSS*EVEFSHEYWMRHALTLAKRARDEREVPVGAVLVLNNRVIGEGWNRAIGLHDPTAHA

EIMALRQGGLVMQNYRLIDATLYSTFEPCVMCAGAMIHSRIGRVVFGVRNAKTGAAGSLMDVLH

YPGMNHRVEITEGILADECAALLCYFFRMPRRVFNAQKKAQSSTD*SGGSSGGSSGSETPGTSES*

*ATPESSGGSSGGS*DKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKERGHFLIEGDLNPDNSD

VDKLFIQLVQTYNQLFEENPINASGVDAKAILSARLSKSRRLENLIAQLPGEKKNGLFGNLIAL

SLGLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLKDN

REKIEKILTFRIPYYVGPLARGNSRFAWMTRKSEETITPWNFEEVVDKGASAQSFIERMTNEDK

NLPNEKVLPKHSLLYEYFTVYNELTKVKYVTEGMRKPAFLSGEQKKAIVDLLFKTNRKVTVKQL

KEDYFKKIECFDSVEISGVEDRFNASLGTYHDLLKIIKDKDFLDNEENEDILEDIVLTLTLFED

REMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQLQNEKLYLYYLQNGR

DMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDK

LIREVKVITLKSKLVSDFRKDFQFYKVREINNYHHAHDAYLNAVVGTALIKKYPKLESEFVYGD

YKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDELEAKGYKEVKKDLIIKLPKYSLF

ELENGRKRMLASAGELQKGNELALPSKYVNFLYLASHYEKLKGSPEDNEQKQLFVEQHKHYLDE

IIEQISEFSKRVILADANLDKVLSAYNKHRDKPIREQAENIIHLFTLTNLGAPAAFKYFDTTID

RKRYTSTKEVLDATLIHQSITGLYETRIDLSQLGGD<u>EGADKRTADGSEFESPKKKRKV</u>*

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-m, which comprises or consists essentially of the following sequence or a fragment thereof having adenosine deaminase activity:

ABE8.20-m (SEQ ID NO: 113)

MSEVEFSHEYWMRHALTLAKRARDEREVPVGAVLVLNNRVIGEGWNRAIGL

HDPTAHAEIMALRQGGLVMQNYRLYDATLYSTFEPCVMCAGAMIHSRIGRV

-continued

VFGVRNAKTGAAGSLMDVLHHPGMNHRVEITEGILADECAALLCRFFRMPR

RVFNAQKKAQSSTDSGGSSGGSSGSETPGTSESATPESSGGSSGGSDKKYS

```
IGLAIGTNSVGWAVITDEYKVPSKKEKVLGNTDRHSIKKNLIGALLFDSGE

TAEATRLKRTARRRYTRRKNRICYLQEIFSNEMAKVDDSFFHRLEESFLVE

EDKKHERHPIFGNIVDEVAYHEKYPTIYHLRKKLVDSTDKADLRLIYLALA

HMIKERGHFLIEGDLNPDNSDVDKLFIQLVQTYNQLFEENPINASGVDAKA

ILSARLSKSRRLENLIAQLPGEKKNGLFGNLIALSLGLTPNEKSNEDLAED

AKLQLSKDTYDDDLDNLLAQIGDQYADLFLAAKNLSDAILLSDILRVNTEI

TKAPLSASMIKRYDEHHQDLTLLKALVRQQLPEKYKEIFFDQSKNGYAGYI

DGGASQEEFYKFIKPILEKMDGTEELLVKLNREDLLRKQRTFDNGSIPHQI

HLGELHAILRRQEDFYPFLKDNREKIEKILTFRIPYYVGPLARGNSRFAWM

TRKSEETITPWNFEEVVDKGASAQSFIERMTNEDKNLPNEKVLPKHSLLYE

YFTVYNELTKVKYVTEGMRKPAFLSGEQKKAIVDLLFKTNRKVTVKQLKED

YFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLING

IRDKQSGKTILDFLKSDGFANRNFMQLIHDDSLTEKEDIQKAQVSGQGDSL

HEHIANLAGSPAIKKGILQTVKVVDELVKVMGRHKPENIVIEMARENQTTQ

KGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSE

EVVKKMKNYWRQLLNAKLITQRKFDNLTKAERGGLSELDKAGFIKRQLVET

RQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSE

QEIGKATAKYFFYSNIMNFFKTEITLANGEIRKRPLIETNGETGEIVWDKG

RDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVI

LADANLDKVLSAYNKHRDKPIREQAENIIHLFTLTNLGAPAAFKYFDTTID

RKRYTSTKEVLDATLIHQSITGLYETRIDLSQLGGDEGADKRTADGSEFES

PKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, the base editor is ABE8.20-d, which comprises or consists essentially of the following sequence or a fragment thereof having adenosine deaminase activity:

```
ABE8.20-d
                                                   (SEQ ID NO: 114)
MSEVEFSHEYWMRHALTLAKRAWDEREVPVGAVLVHNNRVIGEGWNRPIGRHDPTAHAEIMALR

QGGLVMQNYRLIDATLYVTLEPCVMCAGAMIHSRIGRVVFGARDAKTGAAGSLMDVLHHPGMNH

RVEITEGILADECAALLSDFFRMRRQEIKAQKKAQSSTDSGGSSGGSSGSETPGTSESATPESS

GGSSGGSSEVEFSHEYWMRHALTLAKRARDEREVPVGAVLVLNNRVIGEGWNRAIGLHDPTAHA

EIMALRQGGLVMQNYRLYDATLYSTFEPCVMCAGAMIHSRIGRVVFGVRNAKTGAAGSLMDVLH

HPGMNHRVEITEGILADECAALLCRFFRMPRRVFNAQKKAQSSTDSGGSSGGSSGSETPGTSES

ATPESSGGSSGGSDKKYSIGLAIGTNSVGWAVITDEYKVPSKKFKVLGNTDRHSIKKNLIGALL

FDSGETAEATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDLNPDNSD

VDKLFIQLVQTYNQLFEENPINASGVDAKAILSARLSKSRRLENLIAQLPGEKKNGLFGNLIAL

SLGLTPNFKSNFDLAEDAKLQLSKDTYDDDLDNLLAQIGDQYADLFLAAKNLSDAILLSDILRV

NTEITKAPLSASMIKRYDEHHQDLTLLKALVRQQLPEKYKEIFFDQSKNGYAGYIDGGASQEEF

YKFIKPILEKMDGTEELLVKLNREDLLRKQRTFDNGSIPHQIHLGELHAILRRQEDFYPFLKDN

REKIEKILTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNRKVTVKQL

KEDYFKKIECFDSVEISGVEDRFNASLGTYHDLLKIIKDKDFLDNEENEDILEDIVLTLTLFED

REMIEERLKTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQLQNEKLYLYYLQNGR

DMYVDQELDINRLSDYDVDHIVPQSFLKDDSIDNKVLTRSDKNRGKSDNVPSEEVVKKMKNYWR

QLLNAKLITQRKFDNLTKAERGGLSELDKAGFIKRQLVETRQITKHVAQILDSRMNTKYDENDK
```

-continued

```
LIREVKVITLKSKLVSDFRKDFQFYKVREINNYHHAHDAYLNAVVGTALIKKYPKLESEFVYGD

YKVYDVRKMIAKSEQEIGKATAKYFFYSNIMNFFKTEITLANGEIRKRPLIETNGETGEIVWDK

GRDFATVRKVLSMPQVNIVKKTEVQTGGFSKESILPKRNSDKLIARKKDWDPKKYGGFDSPTVA

YSVLVVAKVEKGKSKKLKSVKELLGITIMERSSFEKNPIDFLEAKGYKEVKKDLIIKLPKYSLF

ELENGRKRMLASAGELQKGNELALPSKYVNFLYLASHYEKLKGSPEDNEQKQLFVEQHKHYLDE

IIEQISEFSKRVILADANLDKVLSAYNKHRDKPIREQAENIIHLFTLTNLGAPAAFKYFDTTID

RKRYTSTKEVLDATLIHQSITGLYETRIDLSQLGGDEGADKRTADGSEFESPKKKRKV*
```

In the above sequence, the plain text denotes an adenosine deaminase sequence, bold sequence indicates sequence derived from Cas9, the italicized sequence denotes a linker sequence, underlined sequence denotes a bipartite nuclear localization sequence, and double underlined sequence indicates mutations.

In some embodiments, an ABE8 of the invention is selected from the following sequences:

```
01. monoABE8.1_bpNLS + Y147T
                                                     (SEQ ID NO: 115)
MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCTFFRMPRQVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 02. monoABE8.1_bpNLS + Y147R
                                                     (SEQ ID NO: 116)
MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCRFFRMPRQVFNAQKKAQSSTDSGGSSGGSSGSETPGTSESATPESSGGSSGGSDKKYSIGLAIG
```

-continued

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 03. monoABE8.1_bpNLS + Q154S (SEQ ID NO: 117)

MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCYFFRMPRSVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 04. monoABE8.1_bpNLS + Y123H (SEQ ID NO: 118)

MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHHPGMNHRVEITEGILADE

CAALLCYFFRMPRQVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 05. monoABE8.1_bpNLS + V82S (SEQ ID NO: 119)

MSEVEFSHEYWMRHALTLAKRARDEREVPVGAVLVLNNRVIGEGWNRAIGLHDPTAHAEIMALRQGGLVM

QNYRLIDATLYSTFEPCVMCAGAMIHSRIGRVVFGVRNAKTGAAGSLMDVLHYPGMNHRVEITEGILADE

CAALLCYFFRMPRQVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

-continued

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 06. monoABE8.1_bpNLS + T166R
(SEQ ID NO: 120)
MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCYFFRMPRQVFNAQKKAQSSRDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 07. monoABE8.1_bpNLS + Q154R
(SEQ ID NO: 121)
MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCYFFRMPRRVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

-continued

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 08. monoABE8.1_bpNLS + Y147R_Q154R_Y123H (SEQ ID NO: 122)

MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHHPGMNHRVEITEGILADE

CAALLCRFFRMPRRVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

-continued

ISEFSKRVILADANLDKVLSAYNKHRDKPIREQAENIIHLFTLTNLGAPAAFKYFDTTIDRKQYRSTKEV
LDATLIHQSITGLYETRIDLSQLGGDEGADKRTADGSEFESPKKKRKV 09. monoABE8.1_bpNLS + Y147R_Q154R_I76Y (SEQ ID NO: 123)

MSEVEFSHEYWMRHALTLAKRARDEREVPVGAVLVLNNRVIGEGWNRAIGLHDPTAHAEIMALRQGGLVM
QNYRLYDATLYVTFEPCVMCAGAMIHSRIGRVVFGVRNAKTGAAGSLMDVLHYPGMNHRVEITEGILADE
CAALLCRFFRMPRRVFNAQKKAQSSTDSGGSSGGSSGSETPGTSESATPESSGGSSGGSDKKYSIGLAIG
TNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRL
ENLIAQLPGEKKNGLFGNLIALSLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPHQIHLGELHAILRRQEDFYPF
LKDNREKIEKILTFRIPYYVGPLARGNSRFAWMTRKSEETITPWNFEEVVDKGASAQSFIERMTNFDKNL
PNEKVLPKHSLLYEYFTVYNELTKVKYVTEGMRKPAFLSGEQKKAIVDLLFKTNRKVTVKQLKEDYFKKI
ECFDSVEISGVEDRFNASLGTYHDLLKIIKDKDFLDNEENEDILEDIVLTLTLFEDREMIEERLKTYAHL
FDDKVMKQLKRRRYTGWGRLSRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIEMARENQTTQKGQKNSRERMK
RIEEGIKELGSQILKEHPVENTQLQNEKLYLYYLQNGRDMYVDQELDINRLSDYDVDHIVPQSFLKDDSI
DNKVLTRSDKNRGKSDNVPSEEVVKKMKNYWRQLLNAKLITQRKFDNLTKAERGGLSELDKAGFIKRQLV
ETRQITKHVAQILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILPKRNSDKLIARKKDWDPKKYG
GFVSPTVAYSVLVVAKVEKGKSKKLKSVKELLGITIMERSSFEKNPIDFLEAKGYKEVKKDLIIKLPKYS
LFELENGRKRMLASARELQKGNELALPSKYVNFLYLASHYEKLKGSPEDNEQKQLFVEQHKHYLDEIIEQ
ISEFSKRVILADANLDKVLSAYNKHRDKPIREQAENIIHLFTLTNLGAPAAFKYFDTTIDRKQYRSTKEV
LDATLIHQSITGLYETRIDLSQLGGDEGADKRTADGSEFESPKKKRKV 10. monoABE8.1_bpNLS + Y147R_Q154R_T166R (SEQ ID NO: 124)

MSEVEFSHEYWMRHALTLAKRARDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHYPGMNHRVEITEGILADE
CAALLCRFFRMPRRVFNAQKKAQSSRDSGGSSGGSSGSETPGTSESATPESSGGSSGGSDKKYSIGLAIG
TNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRL
ENLIAQLPGEKKNGLFGNLIALSLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPHQIHLGELHAILRRQEDFYPF
LKDNREKIEKILTFRIPYYVGPLARGNSRFAWMTRKSEETITPWNFEEVVDKGASAQSFIERMTNFDKNL
PNEKVLPKHSLLYEYFTVYNELTKVKYVTEGMRKPAFLSGEQKKAIVDLLFKTNRKVTVKQLKEDYFKKI
ECFDSVEISGVEDRFNASLGTYHDLLKIIKDKDFLDNEENEDILEDIVLTLTLFEDREMIEERLKTYAHL
FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 11. monoABE8.1_bpNLS + Y147T_Q154R
(SEQ ID NO: 125)
MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCTFFRMPRRVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV 12. monoABE8.1_bpNLS + Y147T_Q154S
(SEQ ID NO: 126)
MSEVEFSHEYWMRHALTLAKRARDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHYPGMNHRVEITEGILADE

CAALLCTFFRMPRSVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

```
ENLIAQLPGEKKNGLFGNLIALSLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPHQIHLGELHAILRRQEDFYPF
LKDNREKIEKILTFRIPYYVGPLARGNSRFAWMTRKSEETITPWNFEEVVDKGASAQSFIERMTNFDKNL
PNEKVLPKHSLLYEYFTVYNELTKVKYVTEGMRKPAFLSGEQKKAIVDLLFKTNRKVTVKQLKEDYFKKI
ECFDSVEISGVEDRFNASLGTYHDLLKIIKDKDFLDNEENEDILEDIVLTLTLFEDREMIEERLKTYAHL
FDDKVMKQLKRRRYTGWGRLSRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIEMARENQTTQKGQKNSRERMK
RIEEGIKELGSQILKEHPVENTQLQNEKLYLYYLQNGRDMYVDQELDINRLSDYDVDHIVPQSFLKDDSI
DNKVLTRSDKNRGKSDNVPSEEVVKKMKNYWRQLLNAKLITQRKFDNLTKAERGGLSELDKAGFIKRQLV
ETRQITKHVAQILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILPKRNSDKLIARKKDWDPKKYG
GFVSPTVAYSVLVVAKVEKGKSKKLKSVKELLGITIMERSSFEKNPIDFLEAKGYKEVKKDLIIKLPKYS
LFELENGRKRMLASARELQKGNELALPSKYVNFLYLASHYEKLKGSPEDNEQKQLFVEQHKHYLDEIIEQ
ISEFSKRVILADANLDKVLSAYNKHRDKPIREQAENIIHLFTLTNLGAPAAFKYFDTTIDRKQYRSTKEV
LDATLIHQSITGLYETRIDLSQLGGDEGADKRTADGSEFESPKKKRKV 13. monoABE8.1_bpNLS + H123Y123H_Y147R_Q154R_I76Y
                                                          (SEQ ID NO: 127)
MSEVEFSHEYWMRHALTLAKRARDEREVPVGAVLVLNNRVIGEGWNRAIGLHDPTAHAEIMALRQGGLVM
QNYRLYDATLYVTFEPCVMCAGAMIHSRIGRVVFGVRNAKTGAAGSLMDVLHHPGMNHRVEITEGILADE
CAALLCRFFRMPRRVFNAQKKAQSSTDSGGSSGGSSGSETPGTSESATPESSGGSSGGSDKKYSIGLAIG
TNSVGWAVITDEYKVPSKKFKVLGNTDRHSIKKNLIGALLFDSGETAEATRLKRTARRRYTRRKNRICYL
QEIFSNEMAKVDDSFFHRLEESFLVEEDKKHERHPIFGNIVDEVAYHEKYPTIYHLRKKLVDSTDKADLR
LIYLALAHMIKFRGHFLIEGDLNPDNSDVDKLFIQLVQTYNQLFEENPINASGVDAKAILSARLSKSRRL
ENLIAQLPGEKKNGLFGNLIALSLGLTPNFKSNFDLAEDAKLQLSKDTYDDDLDNLLAQIGDQYADLFLA
AKNLSDAILLSDILRVNTEITKAPLSASMIKRYDEHHQDLTLLKALVRQQLPEKYKEIFFDQSKNGYAGY
IDGGASQEEFYKFIKPILEKMDGTEELLVKLNREDLLRKQRTFDNGSIPHQIHLGELHAILRRQEDFYPF
LKDNREKIEKILTFRIPYYVGPLARGNSRFAWMTRKSEETITPWNFEEVVDKGASAQSFIERMTNFDKNL
PNEKVLPKHSLLYEYFTVYNELTKVKYVTEGMRKPAFLSGEQKKAIVDLLFKTNRKVTVKQLKEDYFKKI
ECFDSVEISGVEDRFNASLGTYHDLLKIIKDKDFLDNEENEDILEDIVLTLTLFEDREMIEERLKTYAHL
FDDKVMKQLKRRRYTGWGRLSRKLINGIRDKQSGKTILDFLKSDGFANRNFMQLIHDDSLTFKEDIQKAQ
VSGQGDSLHEHIANLAGSPAIKKGILQTVKVVDELVKVMGRHKPENIVIEMARENQTTQKGQKNSRERMK
RIEEGIKELGSQILKEHPVENTQLQNEKLYLYYLQNGRDMYVDQELDINRLSDYDVDHIVPQSFLKDDSI
DNKVLTRSDKNRGKSDNVPSEEVVKKMKNYWRQLLNAKLITQRKFDNLTKAERGGLSELDKAGFIKRQLV
ETRQITKHVAQILDSRMNTKYDENDKLIREVKVITLKSKLVSDFRKDFQFYKVREINNYHHAHDAYLNAV
VGTALIKKYPKLESEFVYGDYKVYDVRKMIAKSEQEIGKATAKYFFYSNIMNFFKTEITLANGEIRKRPL
IETNGETGEIVWDKGRDFATVRKVLSMPQVNIVKKTEVQTGGFSKESILPKRNSDKLIARKKDWDPKKYG
GFVSPTVAYSVLVVAKVEKGKSKKLKSVKELLGITIMERSSFEKNPIDFLEAKGYKEVKKDLIIKLPKYS
LFELENGRKRMLASARELQKGNELALPSKYVNFLYLASHYEKLKGSPEDNEQKQLFVEQHKHYLDEIIEQ
ISEFSKRVILADANLDKVLSAYNKHRDKPIREQAENIIHLFTLTNLGAPAAFKYFDTTIDRKQYRSTKEV
```

-continued

LDATLIHQSITGLYETRIDLSQLGGDEGADKRTADGSEFESPKKKRKV 14. monoABE8.1_bpNLS + V82S + Q154R                    (SEQ ID NO: 128)

MSEVEFSHEYWMRHALTLAKRARDEREVPVGAVLVLNNRVIGEGWNRAIGLHDPTAHAEIMALRQGGLVM

QNYRLIDATLYSTFEPCVMCAGAMIHSRIGRVVFGVRNAKTGAAGSLMDVLHYPGMNHRVEITEGILADE

CAALLCYFFRMPRRVFNAQKKAQSSTDSGGSSGGSSGSETPGTSESATPESSGGSSGGSDKKYSIGLAIG

TNSVGWAVITDEYKVPSKKFKVLGNTDRHSIKKNLIGALLFDSGETAEATRLKRTARRRYTRRKNRICYL

QEIFSNEMAKVDDSFFHRLEESFLVEEDKKHERHPIFGNIVDEVAYHEKYPTIYHLRKKLVDSTDKADLR

LIYLALAHMIKFRGHFLIEGDLNPDNSDVDKLFIQLVQTYNQLFEENPINASGVDAKAILSARLSKSRRL

ENLIAQLPGEKKNGLFGNLIALSLGLTPNFKSNFDLAEDAKLQLSKDTYDDDLDNLLAQIGDQYADLFLA

AKNLSDAILLSDILRVNTEITKAPLSASMIKRYDEHHQDLTLLKALVRQQLPEKYKEIFFDQSKNGYAGY

IDGGASQEEFYKFIKPILEKMDGTEELLVKLNREDLLRKQRTFDNGSIPHQIHLGELHAILRRQEDFYPF

LKDNREKIEKILTFRIPYYVGPLARGNSRFAMMTRKSEETITPWNFEEVVDKGASAQSFIERMTNFDKNL

PNEKVLPKHSLLYEYFTVYNELTKVKYVTEGMRKPAFLSGEQKKAIVDLLFKTNRKVTVKQLKEDYFKKI

ECFDSVEISGVEDRFNASLGTYHDLLKIIKDKDFLDNEENEDILEDIVLTLTLFEDREMIEERLKTYAHL

FDDKVMKQLKRRRYTGWGRLSRKLINGIRDKQSGKTILDFLKSDGFANRNFMQLIHDDSLTFKEDIQKAQ

VSGQGDSLHEHIANLAGSPAIKKGILQTVKVVDELVKVMGRHKPENIVIEMARENQTTQKGQKNSRERMK

RIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQLV

ETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPL

IETNGETGEIVWDKGRDFATVRKVLSMPQVNIVKKTEVQTGGFSKESILPKRNSDKLIARKKDWDPKKYG

GFVSPTVAYSVLVVAKVEKGKSKKLKSVKELLGITIMERSSFEKNPIDFLEAKGYKEVKKDLIIKLPKYS

LFELENGRKRMLASARELQKGNELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAPAAFKYFDTTIDRKQYRSTKEV

LDATLIHQSITGLYETRIDLSQLGGDEGADKRTADGSEFESPKKKRKV

In some embodiments, the base editor is a fusion protein comprising a polynucleotide programmable nucleotide binding domain (e.g., Cas9-derived domain) fused to a nucleobase editing domain (e.g., all or a portion of a deaminase domain). In certain embodiments, the fusion proteins provided herein comprise one or more features that improve the base editing activity of the fusion proteins. For example, any of the fusion proteins provided herein may comprise a Cas9 domain that has reduced nuclease activity. In some embodiments, any of the fusion proteins provided herein may have a Cas9 domain that does not have nuclease activity (dCas9), or a Cas9 domain that cuts one strand of a duplexed DNA molecule, referred to as a Cas9 nickase (nCas9).

In some embodiments, the base editor further comprises a domain comprising all or a portion of a uracil glycosylase inhibitor (UGI). In some embodiments, the base editor comprises a domain comprising all or a portion of a uracil binding protein (UBP), such as a uracil DNA glycosylase (UDG). In some embodiments, the base editor comprises a domain comprising all or a portion of a nucleic acid polymerase. In some embodiments, a nucleic acid polymerase or portion thereof incorporated into a base editor is a translesion DNA polymerase.

In some embodiments, a domain of the base editor can comprise multiple domains. For example, the base editor comprising a polynucleotide programmable nucleotide binding domain derived from Cas9 can comprise an REC lobe and an NUC lobe corresponding to the REC lobe and NUC lobe of a wild-type or natural Cas9. In another example, the base editor can comprise one or more of a RuvCI domain, BH domain, REC1 domain, REC2 domain, RuvCII domain, L1 domain, HNH domain, L2 domain, RuvCIII domain, WED domain, TOPO domain or CTD domain. In some embodiments, one or more domains of the base editor comprise a mutation (e.g., substitution, insertion, deletion) relative to a wild type version of a polypeptide comprising the domain. For example, an HNH domain of a polynucleotide programmable DNA binding domain can comprise an H840A substitution. In another example, a RuvCI domain of a polynucleotide programmable DNA binding domain can comprise a D10A substitution.

Different domains (e.g., adjacent domains) of the base editor disclosed herein can be connected to each other with or without the use of one or more linker domains (e.g., an XTEN linker domain). In some embodiments, a linker domain can be a bond (e.g., covalent bond), chemical group, or a molecule linking two molecules or moieties, e.g., two domains of a fusion protein, such as, for example, a first domain (e.g., Cas9-derived domain) and a second domain (e.g., an adenosine deaminase domain). In some embodiments, a linker is a covalent bond (e.g., a carbon-carbon bond, disulfide bond, carbon-hetero atom bond, etc.). In certain embodiments, a linker is a carbon nitrogen bond of an amide linkage. In certain embodiments, a linker is a cyclic or acyclic, substituted or unsubstituted, branched or unbranched aliphatic or heteroaliphatic linker. In certain embodiments, a linker is polymeric (e.g., polyethylene, polyethylene glycol, polyamide, polyester, etc.). In certain embodiments, a linker comprises a monomer, dimer, or polymer of aminoalkanoic acid. In some embodiments, a linker comprises an aminoalkanoic acid (e.g., glycine, ethanoic acid, alanine, beta-alanine, 3-aminopropanoic acid, 4-aminobutanoic acid, 5-pentanoic acid, etc.). In some embodiments, a linker comprises a monomer, dimer, or polymer of aminohexanoic acid (Ahx). In certain embodiments, a linker is based on a carbocyclic moiety (e.g., cyclopentane, cyclohexane). In other embodiments, a linker comprises a polyethylene glycol moiety (PEG). In certain embodiments, a linker comprises an aryl or heteroaryl moiety. In certain embodiments, the linker is based on a phenyl ring. A linker can include functionalized moieties to facilitate attachment of a nucleophile (e.g., thiol, amino) from the peptide to the linker. Any electrophile can be used as part of the linker. Exemplary electrophiles include, but are not limited to, activated esters, activated amides, Michael acceptors, alkyl halides, aryl halides, acyl halides, and isothiocyanates. In some embodiments, a linker joins a gRNA binding domain of an RNA-programmable nuclease, including a Cas9 nuclease domain, and the catalytic domain of a nucleic acid editing protein. In some embodiments, a linker joins a dCas9 and a second domain (e.g., UGI, etc.).

Typically, a linker is positioned between, or flanked by, two groups, molecules, or other moieties and connected to each one via a covalent bond, thus connecting the two. In some embodiments, a linker is an amino acid or a plurality of amino acids (e.g., a peptide or protein). In some embodiments, a linker is an organic molecule, group, polymer, or chemical moiety. In some embodiments, a linker is 2-100 amino acids in length, for example, 2, 3, 4, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length. Longer or shorter linkers are also contemplated. In some embodiments, a linker domain comprises the amino acid sequence SGSETPGTSESATPES (SEQ ID NO: 55), which can also be referred to as the XTEN linker. Any method for linking the fusion protein domains can be employed (e.g., ranging from very flexible linkers of the form (SGGS)n (SEQ ID NO: 129), (GGGS)n (SEQ ID NO: 130), (GGGGS)n (SEQ ID NO: 131), and (G)n, to more rigid linkers of the form (EAAAK)n (SEQ ID NO: 132), (GGS)n, SGSETPGTSESATPES (SEQ ID NO: 55) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference), or $(XP)_n$ motif, in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 133). In some embodiments, the Cas9 domain of the fusion proteins provided herein are fused via a linker comprising the amino acid sequence SGSETPGTSESATPES (SEQ ID NO: 55). In some embodiments, a linker comprises a plurality of proline residues and is 5-21, 5-14, 5-9, 5-7 amino acids in length, e.g., PAPAP (SEQ ID NO: 134), PAPAPA (SEQ ID NO: 135), PAPAPAP (SEQ ID NO: 136), PAPAPAPA (SEQ ID NO: 137), $P(AP)_4$ (SEQ ID NO: 138), $P(AP)_7$ (SEQ ID NO: 139), $P(AP)_{10}$ (SEQ ID NO: 140) (see, e.g., Tan J, Zhang F, Karcher D, Bock R. Engineering of high-precision base editors for site-specific single nucleotide replacement. Nat Commun. 2019 Jan. 25; 10(1):439; the entire contents are incorporated herein by reference). Such proline-rich linkers are also termed "rigid" linkers.

A fusion protein of the invention comprises a nucleic acid editing domain. In some embodiments, the deaminase is an adenosine deaminase. In some embodiments, the deaminase is a vertebrate deaminase. In some embodiments, the deaminase is an invertebrate deaminase. In some embodiments, the deaminase is a human, chimpanzee, gorilla, monkey, cow, dog, rat, or mouse deaminase. In some embodiments, the deaminase is a human deaminase. In some embodiments, the deaminase is a rat deaminase.

Linkers

In certain embodiments, linkers may be used to link any of the peptides or peptide domains of the invention. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is about 3 to about 104 (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, 60, 65, 70, 75, 80, 85, 90, 95, or 100) amino acids in length.

In some embodiments, the adenosine deaminase and the napDNAbp are fused via a linker that is 4, 16, 32, or 104 amino acids in length. In some embodiments, the linker is about 3 to about 104 amino acids in length. In some embodiments, any of the fusion proteins provided herein, comprise an adenosine deaminase and a Cas9 domain that are fused to each other via a linker. Various linker lengths and flexibilities between the deaminase domain (e.g., an engineered ecTadA) and the Cas9 domain can be employed (e.g., ranging from very flexible linkers of the form $(GGGS)_n$ (SEQ ID NO: 130), $(GGGGS)_n$ (SEQ ID NO: 131), and $(G)_n$ to more rigid linkers of the form $(EAAAK)_n$ (SEQ ID NO: 132), $(SGGS)_n$ (SEQ ID NO: 129), SGSETPGTSESATPES (SEQ ID NO: 55) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and $(XP)_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 133). In some embodiments, the adenosine deaminase and the Cas9 domain of any of the fusion proteins provided herein are fused via a linker (e.g., an XTEN linker) comprising the amino acid sequence SGSETPGTSESATPES (SEQ ID NO: 55).

Cas9 Complexes with Guide RNAs

Some aspects of this disclosure provide complexes comprising any of the fusion proteins provided herein, and a guide RNA (e.g., a guide that targets a SCD mutation). Any method for linking the fusion protein domains can be employed (e.g., ranging from very flexible linkers of the form $(GGGS)_n$ (SEQ ID NO: 130), $(GGGGS)_n$ (SEQ ID NO: 131), and $(G)_n$ to more rigid linkers of the form $(EAAAK)_n$ (SEQ ID NO: 132), $(SGGS)_n$ (SEQ ID NO: 129), SGSETPGTSESATPES (SEQ ID NO: 55) (see, e.g., Guilinger J P, Thompson D B, Liu D R. Fusion of catalytically inactive Cas9 to FokI nuclease improves the specificity of genome modification. Nat. Biotechnol. 2014; 32(6): 577-82; the entire contents are incorporated herein by reference) and $(XP)_n$) in order to achieve the optimal length for activity for the nucleobase editor. In some embodiments, n is 1, 2, 3, 4, 5, 6, 7, 8, 9, 10, 11, 12, 13, 14, or 15. In some embodiments, the linker comprises a $(GGS)_n$ motif, wherein n is 1, 3, or 7 (SEQ ID NO: 133). In some embodiments, the Cas9 domain of the fusion proteins provided herein are fused via a linker comprising the amino acid sequence SGSETPGTSESATPES (SEQ ID NO: 55).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence (NGG). In some embodiments, the 3' end of the target sequence is immediately adjacent to a non-canonical PAM sequence (e.g., a sequence listed in Table 1 or 5'NAA-3'). In some embodiments, the guide nucleic acid (e.g., guide RNA) is complementary to a sequence associated with sickle cell disease (SCD).

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Cas12 Complexes with Guide RNAs

Some aspects of this disclosure provide complexes comprising any of the fusion proteins provided herein, and a guide RNA (e.g., a guide that targets a target polynucleotide for editing).

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is a sequence in the genome of a bacteria, yeast, fungi, insect, plant, or animal. In some embodiments, the target sequence is a sequence in the genome of a human. In some embodiments, the 3' end of the target sequence is immediately adjacent to a canonical PAM sequence. In some embodiments, the 3' end of the target sequence is immediately adjacent to a non-canonical PAM sequence.

Some aspects of this disclosure provide methods of using the fusion proteins, or complexes provided herein. For example, some aspects of this disclosure provide methods comprising contacting a DNA molecule with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to an e.g., TTN, DTTN, GTTN, ATTN, ATTC, DTTNT, WTTN, HATY, TTTN, TTTV, TTTC, TG, RTR, or YTN PAM site.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins disclosed herein, to a target site, e.g., a site comprising a mutation to be edited, it is typically necessary to co-express the fusion protein together with a guide RNA. As explained in more detail elsewhere herein, a guide RNA typically comprises a tracrRNA framework allowing for Cas12 binding, and a guide sequence, which confers sequence specificity to the Cas12:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas12:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

The domains of the base editor disclosed herein can be arranged in any order as long as the deaminase domain is internalized in the Cas12 protein. Non-limiting examples of a base editor comprising a fusion protein comprising e.g., a Cas12 domain and a deaminase domain can be arranged as follows:

NH2-[Cas12 domain]-Linker1-[ABE8]-Linker2-[Cas12 domain]-COOH;
NH2-[Cas12 domain]-Linker1-[ABE8]-[Cas12 domain]-COOH;
NH2-[Cas12 domain]-[ABE8]-Linker2-[Cas12 domain]-COOH;
NH2-[Cas12 domain]-[ABE8]-[Cas12 domain]-COOH;
NH2-[Cas12 domain]-Linker1-[ABE8]-Linker2-[Cas12 domain]-[inosine BER inhibitor]-COOH;
NH2-[Cas12 domain]-Linker1-[ABE8]-[Cas12 domain]-[inosine BER inhibitor]-COOH;
NH2-[Cas12 domain]-[ABE8]-Linker2-[Cas12 domain]-[inosine BER inhibitor]-COOH;
NH2-[Cas12 domain]-[ABE8]-[Cas12 domain]-[inosine BER inhibitor]-COOH;
NH2-[inosine BER inhibitor]-[Cas12 domain]-Linker1-[ABE8]-Linker2-[Cas12 domain]-COOH;
NH2-[inosine BER inhibitor]-[Cas12 domain]-Linker1-[ABE8]-[Cas12 domain]-COOH;
NH2-[inosine BER inhibitor]-[Cas12 domain]-[ABE8]-Linker2-[Cas12 domain]-COOH;
NH2-[inosine BER inhibitor]NH2-[Cas12 domain]-[ABE8]-[Cas12 domain]-COOH;

Additionally, in some cases, a Gam protein can be fused to an N terminus of a base editor. In some cases, a Gam protein can be fused to a C terminus of a base editor. The Gam protein of bacteriophage Mu can bind to the ends of double strand breaks (DSBs) and protect them from degradation. In some embodiments, using Gam to bind the free ends of DSB can reduce indel formation during the process of base editing. In some embodiments, 174-residue Gam protein is fused to the N terminus of the base editors. See. Komor, A. C., et al., "Improved base excision repair inhibition and bacteriophage Mu Gam protein yields C:G-to-T:A base editors with higher efficiency and product purity" Science Advances 3:eaao4774 (2017). In some cases, a mutation or mutations can change the length of a base editor domain relative to a wild type domain. For example, a deletion of at least one amino acid in at least one domain can reduce the length of the base editor. In another case, a mutation or mutations do not change the length of a domain relative to a wild type domain. For example, substitution(s) in any domain does/do not change the length of the base editor In some embodiments, the base editing fusion proteins provided herein need to be positioned at a precise location, for example, where a target base is placed within a defined region (e.g., a "deamination window"). In some cases, a target can be within a 4-base region. In some cases, such a defined target region can be approximately 15 bases upstream of the PAM. See Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A. C., et al., "Improved base excision repair inhibition and bacteriophage Mu Gam protein yields C:G-to-T:A base editors with higher efficiency and product purity" Science Advances 3:eaao4774 (2017), the entire contents of which are hereby incorporated by reference.

A defined target region can be a deamination window. A deamination window can be the defined region in which a base editor acts upon and deaminates a target nucleotide. In some embodiments, the deamination window is within a 2, 3, 4, 5, 6, 7, 8, 9, or 10 base regions. In some embodiments, the deamination window is 5, 6, 7, 8, 9, 10, 11, 12, 13, 14, 15, 16, 17, 18, 19, 20, 21, 22, 23, 24, or 25 bases upstream of the PAM.

The base editors of the present disclosure can comprise any domain, feature or amino acid sequence which facilitates the editing of a target polynucleotide sequence. For example, in some embodiments, the base editor comprises a nuclear localization sequence (NLS). In some embodiments, an NLS of the base editor is localized between a deaminase domain and a napDNAbp domain. In some embodiments, an NLS of the base editor is localized C-terminal to a napDNAbp domain.

Protein domains included in the fusion protein can be a heterologous functional domain. Non-limiting examples of protein domains which can be included in the fusion protein include a deaminase domain (e.g., adenosine deaminase), a uracil glycosylase inhibitor (UGI) domain, epitope tags, and reporter gene sequences. Protein domains can be a heterologous functional domain, for example, having one or more of the following activities: transcriptional activation activity, transcriptional repression activity, transcription release factor activity, gene silencing activity, chromatin modifying activity, epigenetic modifying activity, histone modification activity, RNA cleavage activity, and nucleic acid binding activity. Such heterologous functional domains can confer a function activity, such as modification of a target polypeptide associated with target DNA (e.g., a histone, a DNA binding protein, etc.), leading to, for example, histone methylation, histone acetylation, histone ubiquitination, and the like. Other functions and/or activities conferred can include transposase activity, integrase activity, recombinase activity, ligase activity, ubiquitin ligase activity, deubiquitinating activity, adenylation activity, deadenylation activity, SUMOylation activity, deSUMOylation activity, or any combination of the above.

A domain may be detected or labeled with an epitope tag, a reporter protein, other binding domains. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). Additional protein sequences can include amino acid sequences that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions.

In some embodiments, BhCas12b guide polynucleotide has the following sequence (where the T's are replaced by uridines (U's) in the actual gRNA):

BhCas12b sgRNA scaffold (underlined) + 20 nt to 23 nt guide sequence (denoted by $N_n$)
(SEQ ID NO: 141)
5'<u>GTTCTGTCTTTTGGTCAGGACAACCGTCTAGCTATAAGTGCTGCAGGG</u>

<u>TGTGAGAAACTCCTATTGCTGGACGATGTCTCTTACGAGGCATTAGCAC</u>N

NNNNNNNNNNNNNNNNNNNN-3'

In some embodiments, BvCas12b and AaCas12b guide polynucleotides have the following sequences (where the T's are replaced by uridines (U's) in the actual gRNA):

BvCas12b sgRNA scaffold (underlined) + 20 nt to 23 nt guide sequence (denoted by $N_n$)
(SEQ ID NO: 142)
5'<u>GACCTATAGGGTCAATGAATCTGTGCGTGTGCCATAAGTAATTAAAAA</u>

<u>TTACCCACCACAGGAGCACCTGAAAACAGGTGCTTGGCAC</u>NNNNNNNNNN

NNNNNNNNNN-3'

AaCas12b sgRNA scaffold (underlined) + 20 nt to 23 nt guide sequence (denoted by $N_n$)
(SEQ ID NO: 143)
5'<u>GTCTAAAGGACAGAATTTTTCAACGGGTGTGCCAATGGCCACTTTCCA</u>

<u>GGTGGCAAAGCCCGTTGAACTTCTCAAAAAGAACGATCTGAGAAGTGGCA</u>

<u>C</u>NNNNNNNNNNNNNNNNNNNN-3'

Methods of Using Fusion Proteins Comprising Adenosine Deaminase Variant and a Cas9 Domain Some aspects of this disclosure provide methods of using the fusion proteins, or complexes provided herein. For example, some aspects of this disclosure provide methods comprising contacting a DNA molecule encoding a mutant form of HBG with any of the fusion proteins provided herein, and with at least one guide RNA, wherein the guide RNA is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence. In some embodiments, the 3' end of the target sequence is immediately adjacent to an NGA, NGCG, NGN, NNGRRT, NNNRRT, NGCG, NGCN, NGTN, NGTN, NGTN, or 5' (TTTV) sequence.

It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues.

It will be apparent to those of skill in the art that in order to target any of the fusion proteins comprising a Cas9 domain and an adenosine deaminase variant (e.g., ABE8), as disclosed herein, to a target site, e.g., a site comprising a mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. Alternatively, the guide RNA and tracrRNA may be provided separately, as two nucleic acid molecules. In some embodiments, the guide RNA comprises a structure, wherein the guide sequence comprises a sequence that is complementary to the target sequence. The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Base Editor Efficiency

CRISPR-Cas9 nucleases have been widely used to mediate targeted genome editing. In most genome editing applications, Cas9 forms a complex with a guide polynucleotide (e.g., single guide RNA (sgRNA)) and induces a double-stranded DNA break (DSB) at the target site specified by the sgRNA sequence. Cells primarily respond to this DSB through the non-homologous end-joining (NHEJ) repair pathway, which results in stochastic insertions or deletions (indels) that can cause frameshift mutations that disrupt the gene. In the presence of a donor DNA template with a high degree of homology to the sequences flanking the DSB, gene correction can be achieved through an alternative pathway known as homology directed repair (HDR). Unfortunately, under most non-perturbative conditions, HDR is inefficient, dependent on cell state and cell type, and dominated by a larger frequency of indels. As most of the known genetic variations associated with human disease are point mutations, methods that can more efficiently and cleanly make precise point mutations are needed. Base editing systems as provided herein provide a new way to provide genome editing without generating double-strand DNA breaks, without requiring a donor DNA template, and without inducing an excess of stochastic insertions and deletions.

The fusion proteins of the invention advantageously modify a specific nucleotide base encoding a H comprising a mutation without generating a significant proportion of indels. An "indel," as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., mutations) versus indels.

In some embodiments, any of base editor systems provided herein result in less than 50%, less than 40%, less than 30%, less than 20%, less than 19%, less than 18%, less than 17%, less than 16%, less than 15%, less than 14%, less than 13%, less than 12%, less than 11%, less than 10%, less than 9%, less than 8%, less than 7%, less than 6%, less than 5%, less than 4%, less than 3%, less than 2%, less than 1%, less than 0.9%, less than 0.8%, less than 0.7%, less than 0.6%, less than 0.5%, less than 0.4%, less than 0.3%, less than 0.2%, less than 0.1%, less than 0.09%, less than 0.08%, less than 0.07%, less than 0.06%, less than 0.05%, less than 0.04%, less than 0.03%, less than 0.02%, or less than 0.01% indel formation in the target polynucleotide sequence.

Some aspects of the disclosure are based on the recognition that any of the base editors provided herein are capable of efficiently generating an intended mutation, such as a point mutation, in a nucleic acid (e.g., a nucleic acid within a genome of a subject) without generating a significant number of unintended mutations, such as unintended point mutations. In some embodiments, any of the base editors provided herein are capable of generating at least 0.01% of intended mutations (i.e. at least 0.01% base editing efficiency). In some embodiments, any of the base editors provided herein are capable of generating at least 0.01%, 1%, 2%, 3%, 4%, 5%, 10%, 15%, 20%, 25%, 30%, 40%, 45%, 50%, 60%, 70%, 80%, 90%, 95%, or 99% of intended mutations.

In some embodiments, the base editors provided herein are capable of generating a ratio of intended mutations to indels that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more.

The number of intended mutations and indels can be determined using any suitable method, for example, as described in International PCT Application Nos. PCT/2017/045381 (WO2018/027078) and PCT/US2016/058344 (WO2017/070632); Komor, A. C., et al., "Programmable editing of a target base in genomic DNA without double-stranded DNA cleavage" Nature 533, 420-424 (2016); Gaudelli, N. M., et al., "Programmable base editing of A•T to G•C in genomic DNA without DNA cleavage" Nature 551, 464-471 (2017); and Komor, A C., et al., "Improved base excision repair inhibition and bacteriophage Mu Gam protein yields C:G-to-T:A base editors with higher efficiency and product purity" Science Advances 3:eaao4774 (2017); the entire contents of which are hereby incorporated by reference.

In some embodiments, to calculate indel frequencies, sequencing reads are scanned for exact matches to two 10-bp sequences that flank both sides of a window in which indels can occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively. In some embodiments, the base editors provided herein can limit formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor.

The number of indels formed at a target nucleotide region can depend on the amount of time a nucleic acid (e.g., a nucleic acid within the genome of a cell) is exposed to a base editor. In some embodiments, the number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing the target nucleotide sequence (e.g., a nucleic acid within the genome of a cell) to a base editor. It should be appreciated that the characteristics of the base editors as described herein can be applied to any of the fusion proteins, or methods of using the fusion proteins provided herein.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, any number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation in a nucleic acid (e.g. a nucleic acid within a genome of a subject) without generating a significant number of unintended mutations. In some embodiments, an intended mutation is a mutation that is generated by a specific base editor bound to a gRNA, specifically designed to alter or correct a HBG mutation. In some embodiments, any of the base editors provided herein are capable of generating a ratio of intended mutations to unintended mutations (e.g., intended mutations: unintended mutations) that is greater than 1:1. In some embodiments, any of the base editors provided herein are capable of generating a ratio of intended mutations to unintended mutations that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described herein may be applied to any of the fusion proteins, or methods of using the fusion proteins provided herein.

Multiplex Editing

In some embodiments, the base editor system provided herein is capable of multiplex editing of a plurality of nucleobase pairs in one or more genes. In some embodiments, the plurality of nucleobase pairs is located in the same gene. In some embodiments, the plurality of nucleobase pairs is located in one or more gene, wherein at least one gene is located in a different locus. In some embodiments, the multiplex editing can comprise one or more guide polynucleotides. In some embodiments, the multiplex editing can comprise one or more base editor system. In some embodiments, the multiplex editing can comprise one or more base editor systems with a single guide polynucleotide. In some embodiments, the multiplex editing can comprise one or more base editor systems with a plurality of guide polynucleotides. In some embodiments, the multiplex editing can comprise one or more guide polynucleotide with a single base editor system. In some embodiments, the multiplex editing can comprise at least one guide polynucleotide that does not require a PAM sequence to target binding to a target polynucleotide sequence. In some embodiments, the multiplex editing can comprise at least one guide polynucleotide that requires a PAM sequence to target binding to a target polynucleotide sequence. In some embodiments, the multiplex editing can comprise a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editor provided herein. It should also be appreciated that the multiplex editing using any of the base editors as described herein can comprise a sequential editing of a plurality of nucleobase pairs.

In some embodiments, the plurality of nucleobase pairs is in one more genes. In some embodiments, the plurality of nucleobase pairs is in the same gene. In some embodiments, at least one gene in the one more genes is located in a different locus.

In some embodiments, the editing is editing of the plurality of nucleobase pairs in at least one protein coding region. In some embodiments, the editing is editing of the plurality of nucleobase pairs in at least one protein non-coding region. In some embodiments, the editing is editing of the plurality of nucleobase pairs in at least one protein coding region and at least one protein non-coding region.

In some embodiments, the editing is in conjunction with one or more guide polynucleotides. In some embodiments, the base editor system can comprise one or more base editor system. In some embodiments, the base editor system can comprise one or more base editor systems in conjunction with a single guide polynucleotide. In some embodiments, the base editor system can comprise one or more base editor system in conjunction with a plurality of guide polynucleotides. In some embodiments, the editing is in conjunction with one or more guide polynucleotide with a single base editor system. In some embodiments, the editing is in conjunction with at least one guide polynucleotide that does not require a PAM sequence to target binding to a target polynucleotide sequence. In some embodiments, the editing is in conjunction with at least one guide polynucleotide that require a PAM sequence to target binding to a target polynucleotide sequence. In some embodiments, the editing is in conjunction with a mix of at least one guide polynucleotide that does not require a PAM sequence to target binding to a target polynucleotide sequence and at least one guide polynucleotide that require a PAM sequence to target binding to a target polynucleotide sequence. It should be appreciated that the characteristics of the multiplex editing using any of the base editors as described herein can be applied to any of combination of the methods of using any of the base editors provided herein. It should also be appreciated that the editing can comprise a sequential editing of a plurality of nucleobase pairs.

Introduction of Gene Edits for Treating Sickle Cell Disease

Exemplary guide RNA spacer sequences and nucleobase changes are provided in Table 10 below.

TABLE 10

Introduction of Gene Regulator Edits

| Gene | Nucleotide change | Base Editor | gRNA Spacer Sequence | PAM |
|---|---|---|---|---|
| HBG1/2 | c. -198 T > C | ABE | GUGGGGAAGGGGCCCCCAAG (SEQ ID NO: 144) | AGG |
| HBG1/2 | c. -198 T > C | ABE | AUUGAGAUAGUGUGGGGAAG (SEQ ID NO: 145) | GGG |
| HBG1/2 | c. -198 T > C | ABE | CAUUGAGAUAGUGUGGGGAA (SEQ ID NO: 146) | GGG |
| HBG1/2 | c. -198 T > C | ABE | GCAUUGAGAUAGUGUGGGGA (SEQ ID NO: 147) | AGG |
| HBG1/2 | c. -198 T > C | ABE | GUGGGGAAGGGGCCCCCAAG (SEQ ID NO: 144) | AGG |
| HBG1/2 | c. -114 ~ -102 deletion | CBE and/or ABE | GCUAUUGGUCAAGGCAAGGC (SEQ ID NO: 148) | TGG |
| HBG1/2 | c. -114 ~ -102 deletion | CBE and/or ABE | CAAGGCUAUUGGUCAAGGCA (SEQ ID NO: 149) | AGG |
| HBG1/2 | c. -114 ~ -102 deletion | CBE and/or ABE | CUUGUCAAGGCUAUUGGUCA (SEQ ID NO: 150) | AGG |
| HBG1/2 | c. -114 ~ -102 deletion | CBE and/or ABE | CUUGACCAAUAGCCUUGACA (SEQ ID NO: 151) | AGG |
| HBG1/2 | c. -114 ~ -102 deletion | CBE and/or ABE | GUUUGCCUUGUCAAGGCUAU (SEQ ID NO: 152) | TGG |
| HBG1/2 | c. -114 ~ -102 deletion | CBE and/or ABE | UGGUCAAGUUUGCCUUGUCA (SEQ ID NO: 153) | AGG |
| HBG1/2 | c. -198 T > C | ABE | UGGGGAAGGGGCCCCCAAGA (SEQ ID NO: 154) | GGA |
| HBG1/2 | c. -198 T > C | ABE | GUGUGGGGAAGGGGCCCCCA (SEQ ID NO: 155) | AGA |
| HBG1/2 | c. -175 T > C | ABE | UCAGACAGAUAUUUGCAUUG (SEQ ID NO: 156) | AGA |
| HBG1/2 | c. -175 T > C | ABE | UUUCAGACAGAUAUUUGCAU (SEQ ID NO: 157) | TGA |
| HBG1/2 | c. -114 ~ -102 deletion | CBE and/or ABE | CUUGCCUUGACCAAUAGCCU (SEQ ID NO: 158) | TGA |
| HBG1/2 | c. -114 ~ -102 deletion | CBE and/or ABE | UAGCCUUGACAAGGCAAACU (SEQ ID NO: 159) | TGA |
| HBG1/2 | c. -90 BCL11A binding | CBE and/or ABE | CAAACUUGACCAAUAGUCUU (SEQ ID NO: 160) | AGA |
| HBG1/2 | c. -198 T > C | ABE | UGUGGGGAAGGGGCCCCCAA (SEQ ID NO: 161) | GAGGAT |
| HBG1/2 | c. -202 C > T, -201 C > T, -198 T > C, -197 C > T, -196 C > T, -195 C > G | CBE and/or ABE | GGGCCCCUUCCCCACACUAU (SEQ ID NO: 162) | CTCAAT |

TABLE 10-continued

Introduction of Gene Regulator Edits

| Gene | Nucleotide change | Base Editor | gRNA Spacer Sequence | PAM |
|---|---|---|---|---|
| HBG1/2 | c. -175 T > C | ABE | CAGACAGAUAUUUGCAUUGA (SEQ ID NO: 163) | GATAGT |
| HBG1/2 | c. -175 T > C | ABE | UUUCAGACAGAUAUUUGCAU (SEQ ID NO: 157) | TGAGAT |
| HBG1/2 | c. -114 ~ -102 deletion | CBE and/or ABE | GCCUUGACAAGGCAAACUUG (SEQ ID NO: 164) | ACCAAT |
| HBG1/2 | c. -114 ~ -102 deletion | CBE and/or ABE | UUGACAAGGCAAACUUGACC (SEQ ID NO: 165) | AATAGT |
| HBG1/2 | c. -90 BCL11A binding | CBE and/or ABE | UGACCAAUAGUCUUAGAGUA (SEQ ID NO: 166) | TCCAGT |
| HBG1/2 | c. -175 T > C | ABE | AGACAGAUAUUUGCAUUGAGAUA (SEQ ID NO: 167) | TTT |

Methods for Editing Nucleic Acids

Some aspects of the disclosure provide methods for editing a nucleic acid. In some embodiments, the method is a method for editing a nucleobase of a nucleic acid molecule encoding a HBG (e.g., a base pair of a double-stranded DNA sequence). In some embodiments, the method comprises the steps of: a) contacting a target region of a nucleic acid (e.g., a double-stranded DNA sequence) with a complex comprising a base editor and a guide nucleic acid (e.g., gRNA), b) inducing strand separation of said target region, c) converting a first nucleobase of said target nucleobase pair in a single strand of the target region to a second nucleobase, and d) cutting no more than one strand of said target region using the nCas9, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., G•C to A•T). In some embodiments, at least 5% of the intended base pairs are edited. In some embodiments, at least 10%, 15%, 20%, 25%, 30%, 35%, 40%, 45%, or 50% of the intended base pairs are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a dCas9 domain. In some embodiments, the base editor protects or binds the non-edited strand. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In one embodiment, the linker is 32 amino acids in length. In another embodiment, a "long linker" is at least about 60 amino acids in length. In other embodiments, the linker is between about 3-100 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein.

In some embodiments, the disclosure provides methods for editing a nucleotide (e.g., SNP in the gene encoding HBG). In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited base pair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Expression of Fusion Proteins in a Host Cell

Fusion proteins of the invention comprising an adenosine deaminase variant may be expressed in virtually any host cell of interest, including but not limited to bacteria, yeast, fungi, insects, plants, and animal cells using routine methods known to the skilled artisan. For example, a DNA encoding an adenosine deaminase of the invention can be cloned by designing suitable primers for the upstream and downstream of CDS based on the cDNA sequence. The cloned DNA may be directly, or after digestion with a restriction enzyme when desired, or after addition of a suitable linker and/or a nuclear localization signal ligated with a DNA encoding one or more additional components of a base editing system. The base editing system is translated in a host cell to form a complex.

A DNA encoding a protein domain described herein can be obtained by chemically synthesizing the DNA, or by connecting synthesized partly overlapping oligoDNA short chains by utilizing the PCR method and the Gibson Assembly method to construct a DNA encoding the full length thereof. The advantage of constructing a full-length DNA by chemical synthesis or a combination of PCR method or Gibson Assembly method is that the codon to be used can be designed in CDS full-length according to the host into which the DNA is introduced. In the expression of a heterologous DNA, the protein expression level is expected to increase by converting the DNA sequence thereof to a codon highly frequently used in the host organism. As the data of codon use frequency in host to be used, for example, the genetic code use frequency database (http://www.kazusa.or.jp/codon/index.html) disclosed in the home page of Kazusa DNA Research Institute can be used, or documents showing the codon use frequency in each host may be referred to. By reference to the obtained data and the DNA sequence to be introduced, codons showing low use frequency in the host from among those used for the DNA sequence may be converted to a codon coding the same amino acid and showing high use frequency.

An expression vector containing a DNA encoding a nucleic acid sequence-recognizing module and/or a nucleic acid base converting enzyme can be produced, for example, by linking the DNA to the downstream of a promoter in a suitable expression vector.

As the expression vector, *Escherichia coli*-derived plasmids (e.g., pBR322, pBR325, pUC12, pUC13); *Bacillus subtilis*-derived plasmids (e.g., pUB110, pTP5, pC194); yeast-derived plasmids (e.g., pSH19, pSH15); insect cell expression plasmids (e.g., pFast-Bac); animal cell expression plasmids (e.g., pA1-11, pXT1, pRc/CMV, pRc/RSV, pcDNAI/Neo); bacteriophages such as .lamda.phage and the like; insect virus vectors such as baculovirus and the like (e.g., BmNPV, AcNPV); animal virus vectors such as retrovirus, vaccinia virus, adenovirus and the like, and the like are used.

As the promoter, any promoter appropriate for a host to be used for gene expression can be used. In a conventional method using DSB, since the survival rate of the host cell sometimes decreases markedly due to the toxicity, it is desirable to increase the number of cells by the start of the induction by using an inductive promoter. However, since sufficient cell proliferation can also be afforded by expressing the nucleic acid-modifying enzyme complex of the present invention, a constitution promoter can also be used without limitation.

For example, when the host is an animal cell, SR.alpha. promoter, SV40 promoter, LTR promoter, CMV (cytomegalovirus) promoter, RSV (Rous sarcoma virus) promoter, MoMuLV (Moloney mouse leukemia virus) LTR, HSV-TK (simple herpes virus thymidine kinase) promoter and the like are used. Of these, CMV promoter, SR.alpha. promoter and the like are preferable.

When the host is *Escherichia coli*, trp promoter, lac promoter, recA promoter, lamda.P.sub.L promoter, 1pp promoter, T7 promoter and the like are preferable.

When the host is genus *Bacillus*, SPO1 promoter, SPO2 promoter, penP promoter and the like are preferable.

When the host is a yeast, Gal 1/10 promoter, PHO5 promoter, PGK promoter, GAP promoter, ADH promoter and the like are preferable.

When the host is an insect cell, polyhedrin promoter, P10 promoter and the like are preferable.

When the host is a plant cell, CaMV35S promoter, CaMV19S promoter, NOS promoter and the like are preferable.

As the expression vector, besides those mentioned above, one containing enhancer, splicing signal, terminator, polyA addition signal, a selection marker such as drug resistance gene, auxotrophic complementary gene and the like, replication origin and the like on demand can be used.

An RNA encoding a protein domain described herein can be prepared by, for example, transcription to mRNA in a vitro transcription system known per se by using a vector encoding DNA encoding the above-mentioned nucleic acid sequence-recognizing module and/or a nucleic acid base converting enzyme as a template.

A fusion protein of the invention can be intracellularly expressed by introducing an expression vector containing a DNA encoding a nucleic acid sequence-recognizing module and/or a nucleic acid base converting enzyme into a host cell, and culturing the host cell.

As the host, genus *Escherichia*, genus *Bacillus*, yeast, insect cell, insect, animal cell and the like are used.

As the genus *Escherichia*, *Escherichia coli* K12.cndot.DH1 [Proc. Natl. Acad. Sci. USA, 60, 160 (1968)], *Escherichia coli* JM103 [Nucleic Acids Research, 9, 309 (1981)], *Escherichia coli* JA221 [Journal of Molecular Biology, 120, 517 (1978)], *Escherichia coli* HB101 [Journal of Molecular Biology, 41, 459 (1969)], *Escherichia coli* C600 [Genetics, 39, 440 (1954)] and the like are used.

As the genus *Bacillus*, *Bacillus subtilis* M1114 [Gene, 24, 255 (1983)], *Bacillus subtilis* 207-21 [Journal of Biochemistry, 95, 87 (1984)] and the like are used.

As the yeast, *Saccharomyces cerevisiae* AH22, AH22R.sup.-, NA87-11A, DKD-5D, 20B-12, *Schizosaccharomyces pombe* NCYC1913, NCYC2036, *Pichia pastoris* KM71 and the like are used.

As the insect cell when the virus is AcNPV, cells of cabbage armyworm larva-derived established line (*Spodoptera frugiperda* cell; Sf cell), MG1 cells derived from the mid-intestine of *Trichoplusia ni*, High Five™ cells derived from an egg of *Trichoplusia ni*, *Mamestra brassicae*-derived cells, Estigmena acrea-derived cells and the like are used. When the virus is BmNPV, cells of *Bombyx mori*-derived established line (*Bombyx mori* N cell; BmN cell) and the like are used as insect cells. As the Sf cell, for example, Sf9 cell (ATCC CRL1711), Sf21 cell [all above, In Vivo, 13, 213-217 (1977)] and the like are used.

As the insect, for example, larva of *Bombyx mori*, *Drosophila*, cricket and the like are used [Nature, 315, 592 (1985)].

As the animal cell, cell lines such as monkey COS-7 cell, monkey Vero cell, Chinese hamster ovary (CHO) cell, dhfr gene-deficient CHO cell, mouse L cell, mouse AtT-20 cell, mouse myeloma cell, rat GH3 cell, human FL cell and the like, pluripotent stem cells such as iPS cell, ES cell and the like of human and other mammals, and primary cultured cells prepared from various tissues are used. Furthermore, zebrafish embryo, *Xenopus* oocyte and the like can also be used.

As the plant cell, suspend cultured cells, callus, protoplast, leaf segment, root segment and the like prepared from various plants (e.g., grain such as rice, wheat, corn and the like, product crops such as tomato, cucumber, eggplant and the like, garden plants such as carnation, *Eustoma russellianum* and the like, experiment plants such as tobacco, *Arabidopsis thaliana* and the like, and the like) are used.

All the above-mentioned host cells may be haploid (monoploid), or polyploid (e.g., diploid, triploid, tetraploid and the like). In the conventional mutation introduction methods, mutation is, in principle, introduced into only one homologous chromosome to produce a hetero gene type. Therefore, desired phenotype is not expressed unless dominant mutation occurs, and homozygosity inconveniently requires labor and time. In contrast, according to the present invention, since mutation can be introduced into any allele on the homologous chromosome in the genome, desired phenotype can be expressed in a single generation even in the case of recessive mutation, which is extremely useful since the problem of the conventional method can be solved.

An expression vector can be introduced by a known method (e.g., lysozyme method, competent method, PEG method, $CaCl_2$ coprecipitation method, electroporation method, the microinjection method, the particle gun method, lipofection method, *Agrobacterium* method and the like) according to the kind of the host.

*Escherichia coli* can be transformed according to the methods described in, for example, Proc. Natl. Acad. Sci. USA, 69, 2110 (1972), Gene, 17, 107 (1982) and the like.

The genus *Bacillus* can be introduced into a vector according to the methods described in, for example, Molecular & General Genetics, 168, 111 (1979) and the like.

A yeast can be introduced into a vector according to the methods described in, for example, Methods in Enzymology, 194, 182-187 (1991), Proc. Natl. Acad. Sci. USA, 75, 1929 (1978) and the like.

An insect cell and an insect can be introduced into a vector according to the methods described in, for example, Bio/Technology, 6, 47-55 (1988) and the like.

An animal cell can be introduced into a vector according to the methods described in, for example, Cell Engineering additional volume 8, New Cell Engineering Experiment Protocol, 263-267 (1995) (published by Shujunsha), and Virology, 52, 456 (1973).

A cell introduced with a vector can be cultured according to a known method according to the kind of the host.

For example, when *Escherichia coli* or genus *Bacillus* is cultured, a liquid medium is preferable as a medium to be used for the culture. The medium preferably contains a carbon source, nitrogen source, inorganic substance and the like necessary for the growth of the transformant. Examples of the carbon source include glucose, dextrin, soluble starch, sucrose and the like; examples of the nitrogen source include inorganic or organic substances such as ammonium salts, nitrate salts, corn steep liquor, peptone, casein, meat extract, soybean cake, potato extract and the like; and examples of the inorganic substance include calcium chloride, sodium dihydrogen phosphate, magnesium chloride and the like. The medium may contain yeast extract, vitamins, growth promoting factor and the like. The pH of the medium is preferably about 5-about 8.

As a medium for culturing *Escherichia coli*, for example, M9 medium containing glucose, casamino acid [Journal of Experiments in Molecular Genetics, 431-433, Cold Spring Harbor Laboratory, New York 1972] is preferable. Where necessary, for example, agents such as 3.beta.-indolylacrylic acid may be added to the medium to ensure an efficient function of a promoter. *Escherichia coli* is cultured at generally about 15-about 43° C. Where necessary, aeration and stirring may be performed.

The genus *Bacillus* is cultured at generally about 30-about 40° C. Where necessary, aeration and stirring may be performed.

Examples of the medium for culturing yeast include Burkholder minimum medium [Proc. Natl. Acad. Sci. USA, 77, 4505 (1980)], SD medium containing 0.5% casamino acid [Proc. Natl. Acad. Sci. USA, 81, 5330 (1984)] and the like. The pH of the medium is preferably about 5-about 8. The culture is performed at generally about 20° C.-about 35° C. Where necessary, aeration and stirring may be performed.

As a medium for culturing an insect cell or insect, for example, Grace's Insect Medium [Nature, 195, 788 (1962)] containing an additive such as inactivated 10% bovine serum and the like as appropriate and the like are used. The pH of the medium is preferably about 6.2 to about 6.4. The culture is performed at generally about 27° C. Where necessary, aeration and stirring may be performed.

As a medium for culturing an animal cell, for example, minimum essential medium (MEM) containing about 5-about 20% of fetal bovine serum [Science, 122, 501 (1952)], Dulbecco's modified Eagle medium (DMEM) [Virology, 8, 396 (1959)], RPMI 1640 medium [The Journal of the American Medical Association, 199, 519 (1967)], 199 medium [Proceeding of the Society for the Biological Medicine, 73, 1 (1950)] and the like are used. The pH of the medium is preferably about 6-about 8. The culture is performed at generally about 30° C.-about 40° C. Where necessary, aeration and stirring may be performed.

As a medium for culturing a plant cell, for example, MS medium, LS medium, B5 medium and the like are used. The pH of the medium is preferably about 5-about 8. The culture is performed at generally about 20° C.-about 30° C. Where necessary, aeration and stirring may be performed.

When a higher eukaryotic cell, such as animal cell, insect cell, plant cell and the like is used as a host cell, a DNA encoding a base editing system of the present invention (e.g., comprising an adenosine deaminase variant) is introduced into a host cell under the regulation of an inducible promoter (e.g., metallothionein promoter (induced by heavy metal ion), heat shock protein promoter (induced by heat shock), Tet-ON/Tet-OFF system promoter (induced by addition or removal of tetracycline or a derivative thereof), steroid-responsive promoter (induced by steroid hormone or a derivative thereof) etc.), the induction substance is added to the medium (or removed from the medium) at an appropriate stage to induce expression of the nucleic acid-modifying enzyme complex, culture is performed for a given period to carry out a base editing and, introduction of a mutation into a target gene, transient expression of the base editing system can be realized.

Prokaryotic cells such as *Escherichia coli* and the like can utilize an inducible promoter. Examples of the inducible promoter include, but are not limited to, lac promoter (induced by IPTG), cspA promoter (induced by cold shock), araBAD promoter (induced by arabinose) and the like.

Alternatively, the above-mentioned inductive promoter can also be utilized as a vector removal mechanism when higher eukaryotic cells, such as animal cell, insect cell, plant cell and the like are used as a host cell. That is, a vector is mounted with a replication origin that functions in a host cell, and a nucleic acid encoding a protein necessary for replication (e.g., SV40 on and large T antigen, oriP and EBNA-1 etc. for animal cells), of the expression of the nucleic acid encoding the protein is regulated by the above-mentioned inducible promoter. As a result, while the vector is autonomously replicatable in the presence of an induction substance, when the induction substance is removed, autonomous replication is not available, and the vector naturally falls off along with cell division (autonomous replication is not possible by the addition of tetracycline and doxycycline in Tet-OFF system vector).

Delivery System
Nucleic Acid-Based Delivery of a Nucleobase Editors and gRNAs

Nucleic acids encoding nucleobase editors according to the present disclosure can be administered to subjects or delivered into cells in vitro (e.g., hematopoietic stem cells, hematopoietic cells, embryonic stem cells, induced pluripotent stem cells (iPSCs), organoids, and cells in vivo (e.g., bone marrow) by art-known methods or as described herein. In one embodiment, nucleobase editors are selectively delivered to cells (e.g., hematopoietic cells or their progenitors, hematopoietic stem cells, and/or induced pluripotent stem cells). In other embodiments, nucleic acids encoding nucleobase editors are delivered to hematopoietic cells or their progenitors, hematopoietic stem cells, and/or induced pluripotent stem cells comprising mutations in the beta-globin gene, HBB (e.g., HbS). Such cells can be used to assay the functional effects of HBB editing. In one embodiment, the effect of an altered HBB is examined in a red blood cell where restoration of normal red blood cell morphology indicates the presence of functional HBB. In one embodiment, nucleobase editors can be delivered by, e.g., vectors (e.g., viral or non-viral vectors), non-vector-based methods (e.g., using naked DNA, DNA complexes, lipid nanoparticles), or a combination thereof.

Nucleic acids encoding nucleobase editors can be delivered directly to cells (e.g., hematopoietic cells or their progenitors, hematopoietic stem cells, and/or induced pluripotent stem cells) as naked DNA or RNA, for instance by means of transfection or electroporation, or can be conjugated to molecules (e.g., N-acetylgalactosamine) promoting uptake by the target cells. Nucleic acid vectors, such as the vectors described herein can also be used.

Nucleic acid vectors can comprise one or more sequences encoding a domain of a fusion protein described herein. A vector can also comprise a sequence encoding a signal peptide (e.g., for nuclear localization, nucleolar localization, or mitochondrial localization), associated with (e.g., inserted into or fused to) a sequence coding for a protein. As one example, a nucleic acid vectors can include a Cas9 coding sequence that includes one or more nuclear localization sequences (e.g., a nuclear localization sequence from SV40), and a adenosine deaminase variant (e.g., ABE8).

The nucleic acid vector can also include any suitable number of regulatory/control elements, e.g., promoters, enhancers, introns, polyadenylation signals, Kozak consensus sequences, or internal ribosome entry sites (IRES). These elements are well known in the art. For hematopoietic cells suitable promoters can include IFNbeta or CD45.

Nucleic acid vectors according to this disclosure include recombinant viral vectors. Exemplary viral vectors are set forth herein. Other viral vectors known in the art can also be used. In addition, viral particles can be used to deliver genome editing system components in nucleic acid and/or peptide form. For example, "empty" viral particles can be assembled to contain any suitable cargo. Viral vectors and viral particles can also be engineered to incorporate targeting ligands to alter target tissue specificity.

In addition to viral vectors, non-viral vectors can be used to deliver nucleic acids encoding genome editing systems according to the present disclosure. One important category of non-viral nucleic acid vectors are nanoparticles, which can be organic or inorganic. Nanoparticles are well known in the art. Any suitable nanoparticle design can be used to deliver genome editing system components or nucleic acids encoding such components. For instance, organic (e.g. lipid and/or polymer) nanoparticles can be suitable for use as delivery vehicles in certain embodiments of this disclosure. Exemplary lipids for use in nanoparticle formulations, and/or gene transfer are shown in Table 11 below.

TABLE 11

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethylammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3β-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammoniun bromide | CLIP-6 | Cationic |
| Ethyldimyristoylphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |
| O,O'-Dimyristyl-N-lysyl aspartate | DMKE | Cationic |
| 1,2-Distearoyl-sn-glycero-3-ethylpho sphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Table 12 lists exemplary polymers for use in gene transfer and/or nanoparticle formulations.

TABLE 12

Polymers Used for Gene Transfer

| Polymer | Abbreviation |
|---|---|
| Poly(ethylene)glycol | PEG |
| Polyethylenimine | PEI |
| Dithiobis (succinimidylpropionate) | DSP |
| Dimethyl-3,3'-dithiobispropionimidate | DTBP |
| Poly(ethylene imine)biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(α-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

Table 13 summarizes delivery methods for a polynucleotide encoding a fusion protein described herein.

TABLE 13

| Delivery | Vector/Mode | Delivery into Non-Dividing Cells | Duration of Expression | Genome Integration | Type of Molecule Delivered |
|---|---|---|---|---|---|
| Physical | (e.g., electroporation, particle gun, Calcium Phosphate transfection) | YES | Transient | NO | Nucleic Acids and Proteins |
| Viral | Retrovirus | NO | Stable | YES | RNA |
| | Lentivirus | YES | Stable | YES/NO with modification | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

In another aspect, the delivery of genome editing system components or nucleic acids encoding such components, for example, a nucleic acid binding protein such as, for example, Cas9 or variants thereof, and a gRNA targeting a genomic nucleic acid sequence of interest, may be accomplished by delivering a ribonucleoprotein (RNP) to cells. The RNP comprises the nucleic acid binding protein, e.g., Cas9, in complex with the targeting gRNA. RNPs may be delivered to cells using known methods, such as electroporation, nucleofection, or cationic lipid-mediated methods, for example, as reported by Zuris, J. A. et al., 2015, *Nat. Biotechnology*, 33(1):73-80. RNPs are advantageous for use in CRISPR base editing systems, particularly for cells that are difficult to transfect, such as primary cells. In addition, RNPs can also alleviate difficulties that may occur with protein expression in cells, especially when eukaryotic promoters, e.g., CMV or EF1A, which may be used in CRISPR plasmids, are not well-expressed. Advantageously, the use of RNPs does not require the delivery of foreign DNA into cells. Moreover, because an RNP comprising a nucleic acid binding protein and gRNA complex is degraded over time, the use of RNPs has the potential to limit off-target effects. In a manner similar to that for plasmid-based techniques, RNPs can be used to deliver binding protein (e.g., Cas9 variants) and to direct homology directed repair (HDR).

A promoter used to drive base editor coding nucleic acid molecule expression can include AAV ITR. This can be advantageous for eliminating the need for an additional promoter element, which can take up space in the vector. The additional space freed up can be used to drive the expression of additional elements, such as a guide nucleic acid or a selectable marker. ITR activity is relatively weak, so it can be used to reduce potential toxicity due to over expression of the chosen nuclease.

Any suitable promoter can be used to drive expression of the base editor and, where appropriate, the guide nucleic acid. For ubiquitous expression, promoters that can be used include CMV, CAG, CBh, PGK, SV40, Ferritin heavy or light chains, etc. For brain or other CNS cell expression, suitable promoters can include: Synapsin1 for all neurons, CaMKIIalpha for excitatory neurons, GAD67 or GAD65 or VGAT for GABAergic neurons, etc. For liver cell expression, suitable promoters include the Albumin promoter. For lung cell expression, suitable promoters can include SP-B. For endothelial cells, suitable promoters can include ICAM. For hematopoietic cells suitable promoters can include IFN-beta or CD45. For Osteoblasts suitable promoters can include OG-2.

In some embodiments, a base editor of the present disclosure is of small enough size to allow separate promoters to drive expression of the base editor and a compatible guide nucleic acid within the same nucleic acid molecule. For instance, a vector or viral vector can comprise a first promoter operably linked to a nucleic acid encoding the base editor and a second promoter operably linked to the guide nucleic acid.

The promoter used to drive expression of a guide nucleic acid can include: Pol III promoters such as U6 or H1 Use of Pol II promoter and intronic cassettes to express gRNA Adeno Associated Virus (AAV).

In some aspects, the disclosure relates to the viral delivery of a nucleobase editor targeting a HBB mutation using, for example, a viral vector. Exemplary viral vectors include retroviral vectors (e.g. Maloney murine leukemia virus, MML-V), adenoviral vectors (e.g. AD100), lentiviral vectors (HIV and FIV-based vectors), herpesvirus vectors (e.g. HSV-2), and adeno-associated viral vectors.

Viral Vectors

A base editor described herein can therefore be delivered with viral vectors. In some embodiments, a base editor disclosed herein can be encoded on a nucleic acid that is contained in a viral vector. In some embodiments, one or more components of the base editor system can be encoded on one or more viral vectors. For example, a base editor and guide nucleic acid can be encoded on a single viral vector. In other cases, the base editor and guide nucleic acid are encoded on different viral vectors. In either case, the base editor and guide nucleic acid can each be operably linked to a promoter and terminator. The combination of components encoded on a viral vector can be determined by the cargo size constraints of the chosen viral vector.

The use of RNA or DNA viral based systems for the delivery of a base editor takes advantage of highly evolved processes for targeting a virus to specific cells in culture or in the host and trafficking the viral payload to the nucleus or host cell genome. Viral vectors can be administered directly to cells in culture, patients (in vivo), or they can be used to treat cells in vitro, and the modified cells can optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

Viral vectors can include lentivirus (e.g., HIV and FIV-based vectors), Adenovirus (e.g., AD100), Retrovirus (e.g., Maloney murine leukemia virus, MML-V), herpesvirus vectors (e.g., HSV-2), and Adeno-associated viruses (AAVs), or other plasmid or viral vector types, in particular, using formulations and closes from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific base editing, the expression of the base editor and optional guide nucleic acid can be driven by a cell-type specific promoter.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (See, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); PCT/US94/05700).

Retroviral vectors, especially lentiviral vectors, can require polynucleotide sequences smaller than a given length for efficient integration into a target cell. For example, retroviral vectors of length greater than 9 kb can result in low viral titers compared with those of smaller size. In some aspects, a base editor of the present disclosure is of sufficient size so as to enable efficient packaging and delivery into a target cell via a retroviral vector. In some embodiments, a base editor is of a size so as to allow efficient packing and delivery even when expressed together with a guide nucleic acid and/or other components of a targetable nuclease system.

In applications where transient expression is preferred, adenoviral based systems can be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors can also be used to transduce cells with target nucleic acids, e.g., in the in vitro production of nucleic acids and peptides, and for in vivo and ex vivo gene therapy procedures (See, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

AAV is a small, single-stranded DNA dependent virus belonging to the parvovirus family. The 4.7 kb wild-type (wt) AAV genome is made up of two genes that encode four replication proteins and three capsid proteins, respectively, and is flanked on either side by 145-bp inverted terminal repeats (ITRs). The virion is composed of three capsid proteins, Vp1, Vp2, and Vp3, produced in a 1:1:10 ratio from the same open reading frame but from differential splicing (Vp1) and alternative translational start sites (Vp2 and Vp3, respectively). Vp3 is the most abundant subunit in the virion and participates in receptor recognition at the cell surface defining the tropism of the virus. A phospholipase domain, which functions in viral infectivity, has been identified in the unique N terminus of Vp1.

Similar to wt AAV, recombinant AAV (rAAV) utilizes the cis-acting 145-bp ITRs to flank vector transgene cassettes, providing up to 4.5 kb for packaging of foreign DNA. Subsequent to infection, rAAV can express a fusion protein of the invention and persist without integration into the host genome by existing episomally in circular head-to-tail concatemers. Although there are numerous examples of rAAV success using this system, in vitro and in vivo, the limited packaging capacity has limited the use of AAV-mediated gene delivery when the length of the coding sequence of the gene is equal or greater in size than the wt AAV genome.

Viral vectors can be selected based on the application. For example, for in vivo gene delivery, AAV can be advantageous over other viral vectors. In some embodiments, AAV allows low toxicity, which can be due to the purification method not requiring ultra-centrifugation of cell particles that can activate the immune response. In some embodiments, AAV allows low probability of causing insertional mutagenesis because it doesn't integrate into the host genome. Adenoviruses are commonly used as vaccines because of the strong immunogenic response they induce. Packaging capacity of the viral vectors can limit the size of the base editor that can be packaged into the vector.

AAV has a packaging capacity of about 4.5 Kb or 4.75 Kb including two 145 base inverted terminal repeats (ITRs). This means disclosed base editor as well as a promoter and transcription terminator can fit into a single viral vector. Constructs larger than 4.5 or 4.75 Kb can lead to significantly reduced virus production. For example, SpCas9 is quite large, the gene itself is over 4.1 Kb, which makes it difficult for packing into AAV. Therefore, embodiments of the present disclosure include utilizing a disclosed base editor which is shorter in length than conventional base editors. In some examples, the base editors are less than 4 kb. Disclosed base editors can be less than 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb. In some embodiments, the disclosed base editors are 4.5 kb or less in length.

An AAV can be AAV1, AAV2, AAV5 or any combination thereof. One can select the type of AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. A tabulation of certain AAV serotypes as to these cells can be found in Grimm, D. et al, J. Virol. 82: 5887-5911 (2008)).

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses can be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media is changed to OptiMEM (serum-free) media and transfection was done 4 hours later. Cells are transfected with 10 µg of lentiviral transfer plasmid (pCasES10) and the following packaging plasmids: 5 µg of pMD2. G (VSV-g pseudotype), and 7.5 µg of psPAX2 (gag/pol/rev/tat). Transfection can be done in 4 mL OptiMEM with a cationic lipid delivery agent (50 ul Lipofectamine 2000 and 100 ul Plus reagent). After 6 hours, the media is changed to antibiotic-free DMEM with 10% fetal bovine serum. These methods use serum during cell culture, but serum-free methods are preferred.

Lentivirus can be purified as follows. Viral supernatants are harvested after 48 hours. Supernatants are first cleared of debris and filtered through a 0.45 µm low protein binding (PVDF) filter. They are then spun in an ultracentrifuge for 2 hours at 24,000 rpm. Viral pellets are resuspended in 50 µl of DMEM overnight at 4° C. They are then aliquoted and immediately frozen at −80° C.

In another embodiment, minimal non-primate lentiviral vectors based on the equine infectious anemia virus (EIAV) are also contemplated. In another embodiment, RETINOSTAT®, an equine infectious anemia virus-based lentiviral gene therapy vector that expresses angiostatic proteins endostatin and angiostatin that is contemplated to be delivered via a subretinal injection. In another embodiment, use of a self-inactivating lentiviral vector is contemplated.

Any RNA of the systems, for example a guide RNA or a base editor-encoding mRNA, can be delivered in the form of RNA. Base editor-encoding mRNA can be generated using in vitro transcription. For example, nuclease mRNA can be synthesized using a PCR cassette containing the following elements: T7 promoter, optional kozak sequence (GCCACC), nuclease sequence, and 3' UTR such as a 3' UTR from beta globin-polyA tail. The cassette can be used for transcription by T7 polymerase. Guide polynucleotides (e.g., gRNA) can also be transcribed using in vitro transcription from a cassette containing a T7 promoter, followed by the sequence "GG", and guide polynucleotide sequence.

To enhance expression and reduce possible toxicity, the base editor-coding sequence and/or the guide nucleic acid can be modified to include one or more modified nucleoside e.g. using pseudo-U or 5-Methyl-C.

The small packaging capacity of AAV vectors makes the delivery of a number of genes that exceed this size and/or the use of large physiological regulatory elements challenging. These challenges can be addressed, for example, by dividing the protein(s) to be delivered into two or more fragments, wherein the N-terminal fragment is fused to a split intein-N and the C-terminal fragment is fused to a split intein-C. These fragments are then packaged into two or more AAV vectors. As used herein, "intein" refers to a self-splicing protein intron (e.g., peptide) that ligates flanking N-terminal and C-terminal exteins (e.g., fragments to be joined). The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

A fragment of a fusion protein of the invention can vary in length. In some embodiments, a protein fragment ranges from 2 amino acids to about 1000 amino acids in length. In some embodiments, a protein fragment ranges from about 5 amino acids to about 500 amino acids in length. In some embodiments, a protein fragment ranges from about 20 amino acids to about 200 amino acids in length. In some embodiments, a protein fragment ranges from about 10 amino acids to about 100 amino acids in length. Suitable protein fragments of other lengths will be apparent to a person of skill in the art.

In one embodiment, dual AAV vectors are generated by splitting a large transgene expression cassette in two separate halves (5' and 3' ends, or head and tail), where each half of the cassette is packaged in a single AAV vector (of <5 kb). The re-assembly of the full-length transgene expression cassette is then achieved upon co-infection of the same cell by both dual AAV vectors followed by: (1) homologous recombination (HR) between 5' and 3' genomes (dual AAV overlapping vectors); (2) ITR-mediated tail-to-head concatemerization of 5' and 3' genomes (dual AAV trans-splicing vectors); or (3) a combination of these two mechanisms (dual AAV hybrid vectors). The use of dual AAV vectors in vivo results in the expression of full-length proteins. The use of the dual AAV vector platform represents an efficient and viable gene transfer strategy for transgenes of >4.7 kb in size.

Inteins

In some embodiments, a portion or fragment of a nuclease (e.g., Cas9) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein. Inteins (intervening protein) are auto-processing domains found in a variety of diverse organisms, which carry out a process known as protein splicing. Protein splicing is a multi-step biochemical reaction comprised of both the cleavage and formation of peptide bonds. While the endogenous substrates of protein splicing are proteins found in intein-containing organisms, inteins can also be used to chemically manipulate virtually any polypeptide backbone.

In protein splicing, the intein excises itself out of a precursor polypeptide by cleaving two peptide bonds, thereby ligating the flanking extein (external protein) sequences via the formation of a new peptide bond. This rearrangement occurs post-translationally (or possibly co-translationally). Intein-mediated protein splicing occurs spontaneously, requiring only the folding of the intein domain.

About 5% of inteins are split inteins, which are transcribed and translated as two separate polypeptides, the N-intein and C-intein, each fused to one extein. Upon translation, the intein fragments spontaneously and non-covalently assemble into the canonical intein structure to carry out protein splicing in trans. The mechanism of protein splicing entails a series of acyl-transfer reactions that result in the cleavage of two peptide bonds at the intein-extein junctions and the formation of a new peptide bond between the N- and C-exteins. This process is initiated by activation of the peptide bond joining the N-extein and the N-terminus of the intein. Virtually all inteins have a cysteine or serine at their N-terminus that attacks the carbonyl carbon of the C-terminal N-extein residue. This N to O/S acyl-shift is facilitated by a conserved threonine and histidine (referred to as the TXXH motif), along with a commonly found aspartate, which results in the formation of a linear (thio) ester intermediate. Next, this intermediate is subject to trans-(thio)esterification by nucleophilic attack of the first C-extein residue (+1), which is a cysteine, serine, or threonine. The resulting branched (thio)ester intermediate is resolved through a unique transformation: cyclization of the highly conserved C-terminal asparagine of the intein. This process is facilitated by the histidine (found in a highly conserved HNF motif) and the penultimate histidine and may also involve the aspartate. This succinimide formation reaction excises the intein from the reactive complex and leaves behind the exteins attached through a non-peptidic linkage. This structure rapidly rearranges into a stable peptide bond in an intein-independent fashion.

In some embodiments, an N-terminal fragment of a base editor (e.g., ABE, CBE) is fused to a split intein-N and a C-terminal fragment is fused to a split intein-C. These fragments are then packaged into two or more AAV vectors. The use of certain inteins for joining heterologous protein fragments is described, for example, in Wood et al., J. Biol. Chem. 289(21); 14512-9 (2014). For example, when fused to separate protein fragments, the inteins IntN and IntC recognize each other, splice themselves out and simultaneously ligate the flanking N- and C-terminal exteins of the protein fragments to which they were fused, thereby reconstituting a full-length protein from the two protein fragments. Other suitable inteins will be apparent to a person of skill in the art.

In some embodiments, an ABE was split into N- and C-terminal fragments at Ala, Ser, Thr, or Cys residues within selected regions of SpCas9. These regions correspond to loop regions identified by Cas9 crystal structure analysis. The N-terminus of each fragment is fused to an intein-N and the C-terminus of each fragment is fused to an intein C at amino acid positions S303, T310, T313, S355, A456, S460, A463, T466, S469, T472, T474, C574, S577, A589, and S590, which are indicated in Bold Capitals in the sequence below.

```
                                          (SEQ ID NO: 1)
  1  mdkkysigld  igtnsvgwav  itdeykvpsk  kfkvlgntdr hsikknliga  llfdsgetae 61  atrlkrtarr  rytrrknric  ylqeifsnem  akvddsffhr leesflveed  kkherhpifg 121  nivdevayhe  kyptiyhlrk  klvdstdkad  lrliylalah mikfrghfli  egdlnpdnsd 181  vdklfiqlvq  tynqlfeenp  inasgvdaka  ilsarlsksr rlenliaqlp  gekknglfgn 241  lialslgltp  nfksnfdlae  daklqlskdt  ydddldnlla qigdqyadlf  laaknlsdai 301  llSdilrvnT  eiTkaplsas  mikrydehhq  dltllkalvr qqlpekykei  ffdqSkngya 361  gyidggasqe  efykfikpil  ekmdgteell  vklnredllr kqrtfdngsi  phqihlgelh 421  ailrrqedfy  pflkdnreki  ekiltfripy  yvgplArgnS rfAwmTrkSe  eTiTpwnfee 481  vvdkgasaqs  fiermtnfdk  nlpnekvlpk  hsllyeyftv yneltkvkyv  tegmrkpafl 541  sgeqkkaivd  llfktnrkvt  vkqlkedyfk  kieCfdSvei sgvedrfnAS  lgtyhdllki
```

```
 601 ikdkdflone enedilediv ltltlfedre mieerlktya hlfddkvmkq lkrrrytgwg 661 rlsrklingi rdkqsgktil dflksdgfan rnfmqlihdd sltfkediqk aqvsgqgdsl 721 hehianlags paikkgilqt vkvvdelvkv mgrhkpeniv iemarenqtt qkgqknsrer 781 mkrieegike lgsqilkehp ventqlqnek lylyylqngr dmyvdqeldi nrlsdydvdh 841 ivpqsflkdd sidnkvltrs dknrgksdnv pseevvkkmk nywrqllnak litqrkfdnl 901 tkaergglse ldkagfikrq lvetrqitkh vaqildsrmn tkydendkli revkvitlks 961 klvsdfrkdf qfykvreinn yhhandayln avvgtalikk ypklesefvy gdykvydvrk 1021 miakseqeig katakyffys nimnffktei tlangeirkr plietngetg eivwdkgrdf 1081 atvrkvlsmp qvnivkktev qtggfskesi lpkrnsdkli arkkdwdpkk yggfdsptva 1141 ysvlvvakve kgkskklksv kellgitime rssfeknpid fleakgykev kkdliiklpk 1201 yslfelengr krmlasagel qkgnelalps kyvnflylas hyeklkgspe dneqkqlfve 1261 qhkhyldeii eqisefskrv iladanldkv lsaynkhrdk pireqaenii hlftltnlga 1321 paafkyfdtt idrkrytstk evldatlihq sitglyetri dlsqlggd
```

Use of Nucleobase Editors to Target HBB Mutations

The suitability of nucleobase editors that target a HBB mutation is evaluated as described herein. In one embodiment, a single cell of interest (e.g., hematopoietic cells or their progenitors, hematopoietic stem cells, and/or induced pluripotent stem cells comprising a HBB mutation) is transduced with a base editing system together with a small amount of a vector encoding a reporter (e.g., GFP). These cells can be immortalized human cell lines, such as 293T, K562 or U2OS. Alternatively, primary cells (e.g., human) may be used. Such cells may be relevant to the eventual cell target.

Delivery may be performed using a viral vector. In one embodiment, transfection may be performed using lipid transfection (such as Lipofectamine or Fugene) or by electroporation. Following transfection, expression of GFP can be determined either by fluorescence microscopy or by flow cytometry to confirm consistent and high levels of transfection. These preliminary transfections can comprise different nucleobase editors to determine which combinations of editors give the greatest activity.

The activity of the nucleobase editor is assessed as described herein, i.e., by sequencing the genome of the cells to detect alterations in a target sequence. For Sanger sequencing, purified PCR amplicons are cloned into a plasmid backbone, transformed, miniprepped and sequenced with a single primer. Sequencing may also be performed using next generation sequencing techniques. When using next generation sequencing, amplicons may be 300-500 bp with the intended cut site placed asymmetrically. Following PCR, next generation sequencing adapters and barcodes (for example Illumina multiplex adapters and indexes) may be added to the ends of the amplicon, e.g., for use in high throughput sequencing (for example on an Illumina MiSeq).

The fusion proteins that induce the greatest levels of target specific alterations in initial tests can be selected for further evaluation.

In particular embodiments, the nucleobase editors are used to target polynucleotides of interest. In one embodiment, a nucleobase editor of the invention is delivered to cells (e.g., hematopoietic cells or their progenitors, hematopoietic stem cells, and/or induced pluripotent stem cells) in conjunction with a guide RNA that is used to target a HBB mutation within the genome of a cell, thereby altering the HBB mutation.

The system can comprise one or more different vectors. In an aspect, the base editor is codon optimized for expression the desired cell type, preferentially a eukaryotic cell, preferably a mammalian cell or a human cell.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ (visited Jul. 9, 2002), and these tables can be adapted in a number of ways. See, Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding an engineered nuclease correspond to the most frequently used codon for a particular amino acid.

Packaging cells are typically used to form virus particles that are capable of infecting a host cell. Such cells include 293 cells, which package adenovirus, and psi.2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA can be packaged in a cell line, which contains a helper plasmid encoding the other AAV genes, namely rep and cap, but lacking ITR sequences. The cell line can also be infected with adenovirus as a helper. The helper virus can promote replication of the AAV vector and expression of AAV genes from the helper plasmid. The helper plasmid in some cases is not packaged in significant amounts due to a lack of ITR sequences. Contamination with adenovirus can be reduced by, e.g., heat treatment to which adenovirus is more sensitive than AAV.

Pharmaceutical Compositions

Other aspects of the present disclosure relate to pharmaceutical compositions comprising any of the base editors, fusion proteins, or the fusion protein-guide polynucleotide complexes described herein. The term "pharmaceutical composition," as used herein, refers to a composition formulated for pharmaceutical use. In some embodiments, the pharmaceutical composition further comprises a pharmaceutically acceptable carrier. In some embodiments, the pharmaceutical composition comprises additional agents (e.g., for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.).

Some nonlimiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient," "carrier," "pharmaceutically acceptable carrier," "vehicle" or the like are used interchangeably herein.

Pharmaceutical compositions can comprise one or more pH buffering compounds to maintain the pH of the formulation at a predetermined level that reflects physiological pH, such as in the range of about 5.0 to about 8.0. The pH buffering compound used in the aqueous liquid formulation can be an amino acid or mixture of amino acids, such as histidine or a mixture of amino acids such as histidine and glycine. Alternatively, the pH buffering compound is preferably an agent which maintains the pH of the formulation at a predetermined level, such as in the range of about 5.0 to about 8.0, and which does not chelate calcium ions. Illustrative examples of such pH buffering compounds include, but are not limited to, imidazole and acetate ions. The pH buffering compound may be present in any amount suitable to maintain the pH of the formulation at a predetermined level.

Pharmaceutical compositions can also contain one or more osmotic modulating agents, i.e., a compound that modulates the osmotic properties (e.g., tonicity, osmolality, and/or osmotic pressure) of the formulation to a level that is acceptable to the blood stream and blood cells of recipient individuals. The osmotic modulating agent can be an agent that does not chelate calcium ions. The osmotic modulating agent can be any compound known or available to those skilled in the art that modulates the osmotic properties of the formulation. One skilled in the art may empirically determine the suitability of a given osmotic modulating agent for use in the inventive formulation. Illustrative examples of suitable types of osmotic modulating agents include, but are not limited to: salts, such as sodium chloride and sodium acetate; sugars, such as sucrose, dextrose, and mannitol; amino acids, such as glycine; and mixtures of one or more of these agents and/or types of agents. The osmotic modulating agent(s) may be present in any concentration sufficient to modulate the osmotic properties of the formulation.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump can be used (see, e.g., Langer, 1990, Science 249: 1527-1533; Sefton, 1989, CRC Crit. Ref. Biomed. Eng. 14:201; Buchwald et al., 1980, Surgery 88:507; Saudek et al, 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228: 190; During et al., 1989, Ann. Neurol. 25:351; Howard et ah, 1989, J. Neurosurg. 71: 105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic use as solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration can be a liquid, e.g., sterile saline, lactated Ringer's or Hank's solution. In addition, the pharmaceutical composition can be in solid forms and re-dissolved or suspended immediately prior to use. Lyophilized forms are also contemplated. The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et ah, Gene Ther. 1999, 6: 1438-47). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein can be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers can be formed from a variety of materials such as glass or plastic. In some embodiments, the container holds a composition that is effective for treating a disease described herein and can have a sterile access port. For example, the container can be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture can further comprise a second container comprising a pharmaceutically-acceptable buffer, such as phosphate-buffered saline, Ringer's solution, or dextrose solution. It can further include other materials desirable from a commercial and user standpoint, including other buffers, diluents, filters, needles, syringes, and package inserts with instructions for use.

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments, the pharmaceutical composition comprises a ribonucleoprotein complex comprising an RNA-guided nuclease (e.g., Cas9) that forms a complex with a gRNA and a cationic lipid. In some embodiments pharmaceutical composition comprises a gRNA, a nucleic acid programmable DNA binding protein, a cationic lipid, and a pharmaceutically acceptable excipient. Pharmaceutical compositions can optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts, for example, for veterinary use.

Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein can be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit. Pharmaceutical formulations can additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, Md., 2006; incorporated in its entirety herein by reference) discloses various excipients used in formulating pharmaceutical compositions and known techniques for the preparation thereof. See also PCT application PCT/US2010/055131 (Publication number WO2011/053982 A8, filed Nov. 2, 2010), incorporated in its entirety herein by reference, for additional suitable methods, reagents, excipients and solvents for producing pharmaceutical compositions comprising a nuclease.

Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

The compositions, as described above, can be administered in effective amounts. The effective amount will depend upon the mode of administration, the particular condition being treated, and the desired outcome. It may also depend upon the stage of the condition, the age and physical condition of the subject, the nature of concurrent therapy, if any, and like factors well-known to the medical practitioner. For therapeutic applications, it is that amount sufficient to achieve a medically desirable result.

In some embodiments, compositions in accordance with the present disclosure can be used for treatment of any of a variety of diseases, disorders, and/or conditions. In some embodiments the compositions can be used for treatment of SCD and symptoms thereof Kits Various aspects of this disclosure provide kits comprising a base editor system. In one embodiment, the kit comprises a nucleic acid construct comprising a nucleotide sequence encoding a nucleobase editor fusion protein. The fusion protein comprises a deaminase (e.g., adenosine deaminase) and a nucleic acid programmable DNA binding protein (napDNAbp). In some embodiments, the kit comprises at least one guide RNA capable of targeting the HBB. In some embodiments, the kit comprises a nucleic acid construct comprising a nucleotide sequence encoding at least one guide RNA capable of targeting the HBB.

The kit provides, in some embodiments, instructions for using the kit to edit one or more mutations (e.g., mutations in HBB). The instructions will generally include information about the use of the kit for editing nucleic acid molecules. In other embodiments, the instructions include at least one of the following: precautions; warnings; clinical studies; and/or references. The instructions may be printed directly on the container (when present), or as a label applied to the container, or as a separate sheet, pamphlet, card, or folder supplied in or with the container. In a further embodiment, a kit can comprise instructions in the form of a label or separate insert (package insert) for suitable operational parameters. In yet another embodiment, the kit can comprise one or more containers with appropriate positive and negative controls or control samples, to be used as standard(s) for detection, calibration, or normalization. The kit can further comprise a second container comprising a pharmaceutically-acceptable buffer, such as (sterile) phosphate-buffered saline, Ringer's solution, or dextrose solution. It can further include other materials desirable from a commercial and user standpoint, including other buffers, diluents, filters, needles, syringes, and package inserts with instructions for use.

Fusion Proteins with Internal Insertions

Provided herein are fusion proteins comprising a heterologous polypeptide fused to a nucleic acid programmable nucleic acid binding protein, for example, a napDNAbp. A heterologous polypeptide can be a polypeptide that is not found in the native or wild-type napDNAbp polypeptide sequence. The heterologous polypeptide can be fused to the napDNAbp at a C-terminal end of the napDNAbp, an N-terminal end of the napDNAbp, or inserted at an internal location of the napDNAbp. In some embodiments, the heterologous polypeptide is inserted at an internal location of the napDNAbp.

In some embodiments, the heterologous polypeptide is a deaminase or a functional fragment thereof. For example, a fusion protein can comprise a deaminase flanked by an N-terminal fragment and a C-terminal fragment of a Cas9 or Cas12 (e.g., Cas12b/C2c1), polypeptide. The deaminase in a fusion protein can be an adenosine deaminase. In some embodiments, the adenosine deaminase is a TadA (e.g., TadA7.10 or TadA*8). In some embodiments, the TadA is a TadA*8. TadA sequences (e.g., TadA7.10 or TadA*8) as described herein are suitable deaminases for the above-described fusion proteins.

The deaminase can be a circular permutant deaminase. For example, the deaminase can be a circular permutant adenosine deaminase. In some embodiments, the deaminase is a circular permutant TadA, circularly permutated at amino acid residue 116 as numbered in the TadA reference sequence. In some embodiments, the deaminase is a circular permutant TadA, circularly permutated at amino acid residue 136 as numbered in the TadA reference sequence. In some embodiments, the deaminase is a circular permutant TadA, circularly permutated at amino acid residue 65 as numbered in the TadA reference sequence.

The fusion protein can comprise more than one deaminase. The fusion protein can comprise, for example, 1, 2, 3, 4, 5 or more deaminases. In some embodiments, the fusion protein comprises one deaminase. In some embodiments, the fusion protein comprises two deaminases. The two or more deaminases in a fusion protein can be an adenosine deaminase. cytidine deaminase, or a combination thereof, e.g., as described in PCT/US19/44935. The two or more deaminases can be homodimers. The two or more deaminases can be heterodimers. The two or more deaminases can be inserted in tandem in the napDNAbp. In some embodiments, the two or more deaminases may not be in tandem in the napDNAbp.

In some embodiments, the napDNAbp in the fusion protein is a Cas9 polypeptide or a fragment thereof. The Cas9 polypeptide can be a variant Cas9 polypeptide. In some embodiments, the Cas9 polypeptide is a Cas9 nickase (nCas9) polypeptide or a fragment thereof. In some embodiments, the Cas9 polypeptide is a nuclease dead Cas9 (dCas9)

polypeptide or a fragment thereof. The Cas9 polypeptide in a fusion protein can be a full-length Cas9 polypeptide. In some cases, the Cas9 polypeptide in a fusion protein may not be a full length Cas9 polypeptide. The Cas9 polypeptide can be truncated, for example, at a N-terminal or C-terminal end relative to a naturally-occurring Cas9 protein. The Cas9 polypeptide can be a circularly permuted Cas9 protein. The Cas9 polypeptide can be a fragment, a portion, or a domain of a Cas9 polypeptide, that is still capable of binding the target polynucleotide and a guide nucleic acid sequence.

In some embodiments, the Cas9 polypeptide is a *Streptococcus pyogenes* Cas9 (SpCas9), *Staphylococcus aureus* Cas9 (SaCas9), *Streptococcus thermophilus* 1 Cas9 (St1Cas9), or fragments or variants thereof.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring Cas9 polypeptide.

The Cas9 polypeptide of a fusion protein can comprise an amino acid sequence that is at least 85%, at least 90%, at least 91%, at least 92%, at least 93%, at least 94%, at least 95%, at least 96%, at least 97%, at least 98%, at least 99%, or at least 99.5% identical to the Cas9 amino acid sequence set forth below (called the "Cas9 reference sequence" below):

In some embodiments, the napDNAbp in the fusion protein is a Cas12 polypeptide, e.g., Cas12b/C2c1, or a fragment thereof. The Cas12 polypeptide can be a variant Cas12 polypeptide.

The heterologous polypeptide (e.g., deaminase) can be inserted in the napDNAbp (e.g., Cas9 or Cas12 (e.g., Cas12b/C2c1)) at a suitable location, for example, such that the napDNAbp retains its ability to bind the target polynucleotide and a guide nucleic acid. A deaminase (e.g., adenosine deaminase) can be inserted into a napDNAbp without compromising function of the deaminase (e.g., base editing activity) or the napDNAbp (e.g., ability to bind to target nucleic acid and guide nucleic acid). A deaminase (e.g., adenosine deaminase) can be inserted in the napDNAbp at, for example, a disordered region or a region comprising a high temperature factor or B-factor as shown by crystallographic studies. Regions of a protein that are less ordered, disordered, or unstructured, for example solvent exposed regions and loops, can be used for insertion without compromising structure or function. A deaminase (e.g., adenosine deaminase) can be inserted in the napDNAbp in a flexible loop region or a solvent-exposed region. In some embodiments, the deaminase (e.g., adenosine deaminase) is inserted in a flexible loop of the Cas9 or the Cas12b/C2c1 polypeptide.

In some embodiments, the insertion location of a deaminase (e.g., adenosine deaminase) is determined by B-factor analysis of the crystal structure of Cas9 polypeptide. In some embodiments, the deaminase (e.g., adenosine deaminase) is (SEQ ID NO: 1)
MDKK<u>YSIGLDIGTNSVGWAVITDEYKVPSKKFKVLGNTDRHSIKKNLIGALLFDSGETA</u>EATRLKRTARR

RYTRRKNRICYLQEIFSNEMAKVDDSFFHRLEESFLVEEDKKHERHPIFGNIVDEVAYHEKYPTIYHLRK

KLVDSTDKADLRLIYLALAHMIKFRGHFLIEGDLNPDNSDVDKLFIQLVQTYNQLFEENPINASGVDAKA

ILSARLSKSRRLENLIAQLPGEKKNGLFGNLIALSLGLTPNFKSNFDLAEDAKLQLSKDTYDDDLDNLLA

QIGDQYADLFLAAKNLSDAILLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLRKQRTFDNGSIPHQIHLGELH

AILRRQEDFYPFLKDNREKIEKILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAFLSGEQKKAIVDLLFKTNRKVT

VKQLKEDYFKKIECFDSVEISGVEDRFNASLGTYHDLLKIIKDKDFLDNEENEDILEDIVLTLTLFEDRE

MIEERLKTYAHLFDDKVMKQLKRRRYTGWGRLSRKLINGIRDKQSGKTILDFLKSDGFANRNFMQLIHDD

SLTFKEDIQKAQVSGQG<u><u>DSLHEHIANLAGSPAIKKGILQTVKVVDELVKVMGRHKPENIVIEMA</u></u>RENQTT

QKGQKNSRERMKRIEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRKFDNLTKAERG<u><u>GLSE</u></u>

<u><u>LDKAGFIKRQLVETRQITKHVAQILDSRMNTKYDENDKLIREVKVITLKSKLVSDFRKDFQFYKVREINN</u></u>

<u><u>YHHAHDAYLNAVVGTALIKKYPKLESEFVYGDYKVYDVRKMIAKSEQEIGKATAKYFFYSNIMNFFKTEI</u></u>

<u><u>TLANGEIRKRPLIETNGETGEIVWDKGRDFATVRKVLSMPQVNIVKKTEVQT</u></u>GGFSKESILPKRNSDKLI

ARKKDWDPKKYGGFDSPTVAYSVLVVAKVEKGKSKKLKSVKELLGITIMERSSFEKNPIDFLEAKGYKEV

KKDLIIKLPKYSLFELENGRKRMLASAGELQKGNELALPSKYVNFLYLASHYEKLKGSPEDNEQKQLFVE

QHKHYLDEIIEQISEFSKRVILADANLDKVLSAYNKHRDKPIREQAENIIHLFTLTNLGAPAAFKYFDTT

IDRKRYTSTKEVLDATLIHQSITGLYETRIDLSQLGGD (single underline: HNH domain; double underline: RuvC domain)

inserted in regions of the Cas9 polypeptide comprising higher than average B-factors (e.g., higher B factors compared to the total protein or the protein domain comprising the disordered region). B-factor or temperature factor can indicate the fluctuation of atoms from their average position (for example, as a result of temperature-dependent atomic vibrations or static disorder in a crystal lattice). A high B-factor (e.g., higher than average B-factor) for backbone atoms can be indicative of a region with relatively high local mobility. Such a region can be used for inserting a deaminase without compromising structure or function. A deaminase (e.g., adenosine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%, 200%, or greater than 200% more than the average B-factor for the total protein. A deaminase (e.g., adenosine deaminase) can be inserted at a location with a residue having a Cα atom with a B-factor that is 50%, 60%, 70%, 80%, 90%, 100%, 110%, 120%, 130%, 140%, 150%, 160%, 170%, 180%, 190%, 200% or greater than 200% more than the average B-factor for a Cas9 protein domain comprising the residue. Cas9 polypeptide positions comprising a higher than average B-factor can include, for example, residues 768, 792, 1052, 1015, 1022, 1026, 1029, 1067, 1040, 1054, 1068, 1246, 1247, and 1248 as numbered in the above Cas9 reference sequence. Cas9 polypeptide regions comprising a higher than average B-factor can include, for example, residues 792-872, 792-906, and 2-791 as numbered in the above Cas9 reference sequence.

A heterologous polypeptide (e.g., deaminase) can be inserted in the napDNAbp at an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. In some embodiments, the heterologous polypeptide is inserted between amino acid positions 768-769, 791-792, 792-793, 1015-1016, 1022-1023, 1026-1027, 1029-1030, 1040-1041, 1052-1053, 1054-1055, 1067-1068, 1068-1069, 1247-1248, or 1248-1249 as numbered in the above Cas9 reference sequence or corresponding amino acid positions thereof. In some embodiments, the heterologous polypeptide is inserted between amino acid positions 769-770, 792-793, 793-794, 1016-1017, 1023-1024, 1027-1028, 1030-1031, 1041-1042, 1053-1054, 1055-1056, 1068-1069, 1069-1070, 1248-1249, or 1249-1250 as numbered in the above Cas9 reference sequence or corresponding amino acid positions thereof. In some embodiments, the heterologous polypeptide replaces an amino acid residue selected from the group consisting of: 768, 791, 792, 1015, 1016, 1022, 1023, 1026, 1029, 1040, 1052, 1054, 1067, 1068, 1069, 1246, 1247, and 1248 as numbered in the above Cas9 reference sequence, or a corresponding amino acid residue in another Cas9 polypeptide. It should be understood that the reference to the above Cas9 reference sequence with respect to insertion positions is for illustrative purposes. The insertions as discussed herein are not limited to the Cas9 polypeptide sequence of the above Cas9 reference sequence, but include insertion at corresponding locations in variant Cas9 polypeptides, for example a Cas9 nickase (nCas9), nuclease dead Cas9 (dCas9), a Cas9 variant lacking a nuclease domain, a truncated Cas9, or a Cas9 domain lacking partial or complete HNH domain.

A heterologous polypeptide (e.g., deaminase) can be inserted in the napDNAbp at an amino acid residue selected from the group consisting of: 768, 792, 1022, 1026, 1040, 1068, and 1247 as numbered in the above Cas9 reference sequence, or a corresponding amino acid residue in another Cas9 polypeptide. In some embodiments, the heterologous polypeptide is inserted between amino acid positions 768-769, 792-793, 1022-1023, 1026-1027, 1029-1030, 1040-1041, 1068-1069, or 1247-1248 as numbered in the above Cas9 reference sequence or corresponding amino acid positions thereof. In some embodiments, the heterologous polypeptide is inserted between amino acid positions 769-770, 793-794, 1023-1024, 1027-1028, 1030-1031, 1041-1042, 1069-1070, or 1248-1249 as numbered in the above Cas9 reference sequence or corresponding amino acid positions thereof. In some embodiments, the heterologous polypeptide replaces an amino acid residue selected from the group consisting of: 768, 792, 1022, 1026, 1040, 1068, and 1247 as numbered in the above Cas9 reference sequence, or a corresponding amino acid residue in another Cas9 polypeptide.

A heterologous polypeptide (e.g., deaminase) can be inserted in the napDNAbp at an amino acid residue as described herein, or a corresponding amino acid residue in another Cas9 polypeptide. In an embodiment, a heterologous polypeptide (e.g., deaminase) can be inserted in the napDNAbp at an amino acid residue selected from the group consisting of: 1002, 1003, 1025, 1052-1056, 1242-1247, 1061-1077, 943-947, 686-691, 569-578, 530-539, and 1060-1077 as numbered in the above Cas9 reference sequence, or a corresponding amino acid residue in another Cas9 polypeptide. The deaminase (e.g., adenosine deaminase) can be inserted at the N-terminus or the C-terminus of the residue or replace the residue. In some embodiments, the deaminase (e.g., adenosine deaminase) is inserted at the C-terminus of the residue.

In some embodiments, an adenosine deaminase (e.g., TadA) is inserted at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, an adenosine deaminase (e.g., TadA) is inserted in place of residues 792-872, 792-906, or 2-791 as numbered in the above Cas9 reference sequence, or a corresponding amino acid residue in another Cas9 polypeptide. In some embodiments, the adenosine deaminase is inserted at the N-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted at the C-terminus of an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide. In some embodiments, the adenosine deaminase is inserted to replace an amino acid selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

In some embodiments, the deaminase (e.g., adenosine deaminase) is inserted at amino acid residue 768 as numbered in the above Cas9 reference sequence, or a corresponding amino acid residue in another Cas9 polypeptide. In some embodiments, the deaminase (e.g., adenosine deaminase) is inserted at the N-terminus of amino acid residue 768 as numbered in the above Cas9 reference sequence, or a corresponding amino acid residue in another Cas9 polypeptide. In some embodiments, the deaminase (e.g., adenosine deaminase) is inserted at the C-terminus of amino acid residue 768 as numbered in the above Cas9 reference sequence, or a corresponding amino acid residue in another Cas9 polypeptide. In some embodiments, the deaminase (e.g., adenosine deaminase) is inserted to replace amino acid residue 768 as numbered in the above Cas9 reference sequence, or a corresponding amino acid residue in another Cas9 polypeptide.

In some embodiments, the deaminase (e.g., adenosine deaminase) is inserted at amino acid residue 791 or is inserted at amino acid residue 792, as numbered in the above Cas9 reference sequence, or a corresponding amino acid residue in another Cas9 polypeptide. In some embodiments, the deaminase (e.g., adenosine deaminase) is inserted at the N-terminus of amino acid residue 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase) is inserted at the C-terminus of amino acid 791 or is inserted at the N-terminus of amino acid 792, as numbered in the above Cas9 reference sequence, or a corresponding amino acid residue in another Cas9 polypeptide. In some embodiments, the deaminase (e.g., adenosine deaminase) is inserted to replace amino acid 791, or is inserted to replace amino acid 792, as numbered in the above Cas9 reference sequence, or a corresponding amino acid residue in another Cas9 polypeptide.

In some embodiments, the deaminase (e.g., adenosine deaminase) is inserted at amino acid residue 1016 as numbered in the above Cas9 reference sequence, or a corresponding amino acid residue in another Cas9 polypeptide. In some embodiments, the deaminase (e.g., adenosine deaminase) is inserted at the N-terminus of amino acid residue 1016 as numbered in the above Cas9 reference sequence, or a corresponding amino acid residue in another Cas9 polypeptide. In some embodiments, the deaminase (e.g., adenosine deaminase) is inserted at the C-terminus of amino acid residue 1016 as numbered in the above Cas9 reference sequence, or a corresponding amino acid residue in another Cas9 polypeptide. In some embodiments, the deaminase (e.g., adenosine deaminase) is inserted to replace amino acid residue 1016 as numbered in the above Cas9 reference sequence, or a corresponding amino acid residue in another Cas9 polypeptide.

In some embodiments, the deaminase (e.g., adenosine deaminase) is inserted at amino acid residue 1022, or is inserted at amino acid residue 1023, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1022 or is inserted at the N-terminus of amino acid residue 1023, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1022 or is inserted at the C-terminus of amino acid residue 1023, as numbered in the above Cas9 reference sequence, or a corresponding amino acid residue in another Cas9 polypeptide. In some embodiments, the deaminase (e.g., adenosine deaminase) is inserted to replace amino acid residue 1022, or is inserted to replace amino acid residue 1023, as numbered in the above Cas9 reference sequence, or a corresponding amino acid residue in another Cas9 polypeptide.

In some embodiments, the deaminase (e.g., adenosine deaminase) is inserted at amino acid residue 1026, or is inserted at amino acid residue 1029, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1026 or is inserted at the N-terminus of amino acid residue 1029, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1026 or is inserted at the C-terminus of amino acid residue 1029, as numbered in the above Cas9 reference sequence, or a corresponding amino acid residue in another Cas9 polypeptide. In some embodiments, the deaminase (e.g., adenosine deaminase) is inserted to replace amino acid residue 1026, or is inserted to replace amino acid residue 1029, as numbered in the above Cas9 reference sequence, or corresponding amino acid residue in another Cas9 polypeptide.

In some embodiments, the deaminase (e.g., adenosine deaminase) is inserted at amino acid residue 1040 as numbered in the above Cas9 reference sequence, or a corresponding amino acid residue in another Cas9 polypeptide. In some embodiments, the deaminase (e.g., adenosine deaminase) is inserted at the N-terminus of amino acid residue 1040 as numbered in the above Cas9 reference sequence, or a corresponding amino acid residue in another Cas9 polypeptide. In some embodiments, the deaminase (e.g., adenosine deaminase) is inserted at the C-terminus of amino acid residue 1040 as numbered in the above Cas9 reference sequence, or a corresponding amino acid residue in another Cas9 polypeptide. In some embodiments, the deaminase (e.g., adenosine deaminase) is inserted to replace amino acid residue 1040 as numbered in the above Cas9 reference sequence, or a corresponding amino acid residue in another Cas9 polypeptide.

In some embodiments, the deaminase (e.g., adenosine deaminase) is inserted at amino acid residue 1052, or is inserted at amino acid residue 1054, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1052 or is inserted at the N-terminus of amino acid residue 1054, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1052 or is inserted at the C-terminus of amino acid residue 1054, as numbered in the above Cas9 reference sequence, or a corresponding amino acid residue in another Cas9 polypeptide. In some embodiments, the deaminase (e.g., adenosine deaminase) is inserted to replace amino acid residue 1052, or is inserted to replace amino acid residue 1054, as numbered in the above Cas9 reference sequence, or a corresponding amino acid residue in another Cas9 polypeptide.

In some embodiments, the deaminase (e.g., adenosine deaminase) is inserted at amino acid residue 1067, or is inserted at amino acid residue 1068, or is inserted at amino acid residue 1069, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1067 or is inserted at the N-terminus of amino acid residue 1068 or is inserted at the N-terminus of amino acid residue 1069, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1067 or is inserted at the C-terminus of amino acid residue 1068 or is inserted at the C-terminus of amino acid residue 1069, as numbered in the above Cas9 reference sequence, or a corresponding amino acid residue in another Cas9 polypeptide. In some embodiments, the deaminase (e.g., adenosine deaminase) is inserted to replace amino acid residue 1067, or is inserted to replace amino acid residue 1068, or is inserted to replace amino acid residue 1069, as numbered in the above Cas9 reference sequence, or a corresponding amino acid residue in another Cas9 polypeptide.

In some embodiments, the deaminase (e.g., adenosine deaminase) is inserted at amino acid residue 1246, or is inserted at amino acid residue 1247, or is inserted at amino acid residue 1248, as numbered in the above Cas9 reference sequence, or a corresponding amino acid residue in another Cas9 polypeptide. In some embodiments, the deaminase (e.g., adenosine deaminase) is inserted at the N-terminus of amino acid residue 1246 or is inserted at the N-terminus of amino acid residue 1247 or is inserted at the N-terminus of amino acid residue 1248, as numbered in the above Cas9 reference sequence, or a corresponding amino acid residue in another Cas9 polypeptide. In some embodiments, the deaminase (e.g., adenosine deaminase) is inserted at the C-terminus of amino acid residue 1246 or is inserted at the C-terminus of amino acid residue 1247 or is inserted at the C-terminus of amino acid residue 1248, as numbered in the above Cas9 reference sequence, or a corresponding amino acid residue in another Cas9 polypeptide. In some embodiments, the deaminase (e.g., adenosine deaminase) is inserted to replace amino acid residue 1246, or is inserted to replace amino acid residue 1247, or is inserted to replace amino acid residue 1248, as numbered in the above Cas9 reference sequence, or a corresponding amino acid residue in another Cas9 polypeptide.

In some embodiments, a heterologous polypeptide (e.g., deaminase) is inserted in a flexible loop of a Cas9 polypeptide. The flexible loop portions can be selected from the group consisting of 530-537, 569-570, 686-691, 943-947, 1002-1025, 1052-1077, 1232-1247, or 1298-1300 as numbered in the above Cas9 reference sequence, or a corresponding amino acid residue in another Cas9 polypeptide. The flexible loop portions can be selected from the group consisting of: 1-529, 538-568, 580-685, 692-942, 948-1001, 1026-1051, 1078-1231, or 1248-1297 as numbered in the above Cas9 reference sequence, or a corresponding amino acid residue in another Cas9 polypeptide.

A heterologous polypeptide (e.g., adenine deaminase) can be inserted into a Cas9 polypeptide region corresponding to amino acid residues: 1017-1069, 1242-1247, 1052-1056, 1060-1077, 1002-1003, 943-947, 530-537, 568-579, 686-691, 1242-1247, 1298-1300, 1066-1077, 1052-1056, or 1060-1077 as numbered in the above Cas9 reference sequence, or a corresponding amino acid residue in another Cas9 polypeptide.

A heterologous polypeptide (e.g., adenine deaminase) can be inserted in place of a deleted region of a Cas9 polypeptide. The deleted region can correspond to an N-terminal or C-terminal portion of the Cas9 polypeptide. In some embodiments, the deleted region corresponds to residues 792-872 as numbered in the above Cas9 reference sequence, or a corresponding amino acid residue in another Cas9 polypeptide. In some embodiments, the deleted region corresponds to residues 792-906 as numbered in the above Cas9 reference sequence, or a corresponding amino acid residue in another Cas9 polypeptide. In some embodiments, the deleted region corresponds to residues 2-791 as numbered in the above Cas9 reference sequence, or a corresponding amino acid residue in another Cas9 polypeptide. In some embodiments, the deleted region corresponds to residues 1017-1069 as numbered in the above Cas9 reference sequence, or corresponding amino acid residues thereof.

Exemplary internal fusion base editors are provided in Table 14A below and are also described in PCT/US20/16285.

TABLE 14A

Insertion loci in Cas9 proteins

| BE ID | Modification | Other ID |
|---|---|---|
| IBE001 | Cas9 TadA ins 1015 | ISLAY01 |
| IBE002 | Cas9 TadA ins 1022 | ISLAY02 |
| IBE003 | Cas9 TadA ins 1029 | ISLAY03 |
| IBE004 | Cas9 TadA ins 1040 | ISLAY04 |
| IBE005 | Cas9 TadA ins 1068 | ISLAY05 |
| IBE006 | Cas9 TadA ins 1247 | ISLAY06 |
| IBE007 | Cas9 TadA ins 1054 | ISLAY07 |
| IBE008 | Cas9 TadA ins 1026 | ISLAY08 |
| IBE009 | Cas9 TadA ins 768 | ISLAY09 |
| IBE020 | delta HNH TadA 792 | ISLAY20 |
| IBE021 | N-term fusion single TadA helix truncated 165-end | ISLAY21 |
| IBE029 | TadA-Circular Permutant 116 ins 1067 | ISLAY29 |
| IBE031 | TadA-Circular Permutant 136 ins 1248 | ISLAY31 |
| IBE032 | TadA-Circular Permutant 136 ins 1052 | ISLAY32 |
| IBE035 | delta 792-872 TadA ins | ISLAY35 |
| IBE036 | delta 792-906 TadA ins | ISLAY36 |
| IBE043 | TadA-Circular Permutant 65 ins 1246 | ISLAY43 |
| IBE044 | TadA ins C-term truncate 2791 | ISLAY44 |

A heterologous polypeptide (e.g., deaminase) can be inserted within a structural or functional domain of a Cas9 polypeptide. A heterologous polypeptide (e.g., deaminase) can be inserted between two structural or functional domains of a Cas9 polypeptide. A heterologous polypeptide (e.g., deaminase) can be inserted in place of a structural or functional domain of a Cas9 polypeptide, for example, after deleting the domain from the Cas9 polypeptide. The structural or functional domains of a Cas9 polypeptide can include, for example, RuvC I, RuvC II, RuvC III, Rec1, Rec2, PI, or HNH.

In some embodiments, the Cas9 polypeptide lacks one or more domains selected from the group consisting of: RuvC I, RuvC II, RuvC III, Rec1, Rec2, PI, or HNH domain. In some embodiments, the Cas9 polypeptide lacks a nuclease domain. In some embodiments, the Cas9 polypeptide lacks an HNH domain. In some embodiments, the Cas9 polypeptide lacks a portion of the HNH domain such that the Cas9 polypeptide has reduced or abolished HNH activity.

In some embodiments, the Cas9 polypeptide comprises a deletion of the nuclease domain, and the deaminase is inserted to replace the nuclease domain. In some embodiments, the HNH domain is deleted and the deaminase is inserted in its place. In some embodiments, one or more of the RuvC domains is deleted and the deaminase is inserted in its place.

A fusion protein comprising a heterologous polypeptide can be flanked by a N-terminal and a C-terminal fragment of a napDNAbp. In some embodiments, the fusion protein comprises a deaminase flanked by a N-terminal fragment and a C-terminal fragment of a Cas9 polypeptide. The N terminal fragment or the C terminal fragment can bind the target polynucleotide sequence. The C-terminus of the N terminal fragment or the N-terminus of the C terminal fragment can comprise a part of a flexible loop of a Cas9 polypeptide. The C-terminus of the N terminal fragment or the N-terminus of the C terminal fragment can comprise a part of an alpha-helix structure of the Cas9 polypeptide. The N-terminal fragment or the C-terminal fragment can comprise a DNA binding domain. The N-terminal fragment or the C-terminal fragment can comprise a RuvC domain. The N-terminal fragment or the C-terminal fragment can comprise an HNH domain. In some embodiments, neither of the N-terminal fragment and the C-terminal fragment comprises an HNH domain.

In some embodiments, the C-terminus of the N terminal Cas9 fragment comprises an amino acid that is in proximity to a target nucleobase when the fusion protein deaminates the target nucleobase. In some embodiments, the N-terminus of the C terminal Cas9 fragment comprises an amino acid that is in proximity to a target nucleobase when the fusion protein deaminates the target nucleobase. The insertion location of different deaminases can be different in order to have proximity between the target nucleobase and an amino acid in the C-terminus of the N terminal Cas9 fragment or the N-terminus of the C terminal Cas9 fragment. For example, the insertion position of an ABE can be at an amino acid residue selected from the group consisting of: 1015, 1022, 1029, 1040, 1068, 1247, 1054, 1026, 768, 1067, 1248, 1052, and 1246 as numbered in the above Cas9 reference sequence, or a corresponding amino acid residue in another Cas9 polypeptide.

The N-terminal Cas9 fragment of a fusion protein (i.e. the N-terminal Cas9 fragment flanking the deaminase in a fusion protein) can comprise the N-terminus of a Cas9 polypeptide. The N-terminal Cas9 fragment of a fusion protein can comprise a length of at least about: 100, 200, 300, 400, 500, 600, 700, 800, 900, 1000, 1100, 1200, or 1300 amino acids. The N-terminal Cas9 fragment of a fusion protein can comprise a sequence corresponding to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1-56, 1-95, 1-200, 1-300, 1-400, 1-500, 1-600, 1-700, 1-718, 1-765, 1-780, 1-906, 1-918, or 1-1100 as numbered in the above Cas9 reference sequence, or a corresponding amino acid residue in another Cas9 polypeptide.

The C-terminal Cas9 fragment of a fusion protein (i.e. the C-terminal Cas9 fragment flanking the deaminase in a fusion protein) can comprise the C-terminus of a Cas9 polypeptide. The C-terminal Cas9 fragment of a fusion protein can comprise a length of at least about: 100, 200, 300, 400, 500, 600, 700, 800, 900, 1000, 1100, 1200, or 1300 amino acids. The C-terminal Cas9 fragment of a fusion protein can comprise a sequence corresponding to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide. The N-terminal Cas9 fragment can comprise a sequence comprising at least: 85%, at least 90%, at least 91%, at least 92%, at least 93%, at least 94%, at least 95%, at least 96%, at least 97%, at least 98%, at least 99%, or at least 99.5% sequence identity to amino acid residues: 1099-1368, 918-1368, 906-1368, 780-1368, 765-1368, 718-1368, 94-1368, or 56-1368 as numbered in the above Cas9 reference sequence, or a corresponding amino acid residue in another Cas9 polypeptide.

The N-terminal Cas9 fragment and C-terminal Cas9 fragment of a fusion protein taken together may not correspond to a full-length naturally occurring Cas9 polypeptide sequence, for example, as set forth in the above Cas9 reference sequence.

The fusion protein described herein can effect targeted deamination with reduced deamination at non-target sites (e.g., off-target sites), such as reduced genome wide spurious deamination. The fusion protein described herein can effect targeted deamination with reduced bystander deamination at non-target sites. The undesired deamination or off-target deamination can be reduced by at least 30%, at least 40%, at least 50%, at least 60%, at least 70%, at least 80%, at least 90%, at least 95%, or at least 99% compared with, for example, an end terminus fusion protein comprising the deaminase fused to a N terminus or a C terminus of a Cas9 polypeptide. The undesired deamination or off-target deamination can be reduced by at least one-fold, at least two-fold, at least three-fold, at least four-fold, at least five-fold, at least tenfold, at least fifteen fold, at least twenty fold, at least thirty fold, at least forty fold, at least fifty fold, at least 60 fold, at least 70 fold, at least 80 fold, at least 90 fold, or at least hundred fold, compared with, for example, an end terminus fusion protein comprising the deaminase fused to a N terminus or a C terminus of a Cas9 polypeptide.

In some embodiments, the deaminase (e.g., adenosine deaminase) of the fusion protein deaminates no more than two nucleobases within the range of an R-loop. In some embodiments, the deaminase of the fusion protein deaminates no more than three nucleobases within the range of the R-loop. In some embodiments, the deaminase of the fusion protein deaminates no more than 2, 3, 4, 5, 6, 7, 8, 9, or 10 nucleobases within the range of the R-loop. An R-loop is a three-stranded nucleic acid structure including a DNA:RNA hybrid, a DNA:DNA or an RNA: RNA complementary structure and the associated with single-stranded DNA. As used herein, an R-loop may be formed when a target polynucleotide is contacted with a CRISPR complex or a base editing complex, wherein a portion of a guide polynucleotide, e.g. a guide RNA, hybridizes with and displaces with a portion of a target polynucleotide, e.g. a target DNA. In some embodiments, an R-loop comprises a hybridized region of a spacer sequence and a target DNA complementary sequence. An R-loop region may be of about 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleobase pairs in length. In some embodiments, the R-loop region is about 20 nucleobase pairs in length. It should be understood that, as used herein, an R-loop region is not limited to the target DNA strand that hybridizes with the guide polynucleotide. For example, editing of a target nucleobase within an R-loop region may be to a DNA strand that comprises the complementary strand to a guide RNA, or may be to a DNA strand that is the opposing strand of the strand complementary to the guide RNA. In some embodiments, editing in the region of the R-loop comprises editing a nucleobase on non-complementary strand (protospacer strand) to a guide RNA in a target DNA sequence.

The fusion protein described herein can effect target deamination in an editing window different from canonical base editing. In some embodiments, a target nucleobase is from about 1 to about 20 bases upstream of a PAM sequence in the target polynucleotide sequence. In some embodiments, a target nucleobase is from about 2 to about 12 bases upstream of a PAM sequence in the target polynucleotide sequence. In some embodiments, a target nucleobase is from about 1 to 9 base pairs, about 2 to 10 base pairs, about 3 to 11 base pairs, about 4 to 12 base pairs, about 5 to 13 base pairs, about 6 to 14 base pairs, about 7 to 15 base pairs, about 8 to 16 base pairs, about 9 to 17 base pairs, about 10 to 18 base pairs, about 11 to 19 base pairs, about 12 to 20 base pairs, about 1 to 7 base pairs, about 2 to 8 base pairs, about 3 to 9 base pairs, about 4 to 10 base pairs, about 5 to 11 base pairs, about 6 to 12 base pairs, about 7 to 13 base pairs, about 8 to 14 base pairs, about 9 to 15 base pairs, about 10 to 16 base pairs, about 11 to 17 base pairs, about 12 to 18 base pairs, about 13 to 19 base pairs, about 14 to 20 base pairs, about 1 to 5 base pairs, about 2 to 6 base pairs, about 3 to 7 base pairs, about 4 to 8 base pairs, about 5 to 9 base pairs, about 6 to 10 base pairs, about 7 to 11 base pairs, about 8 to 12 base pairs, about 9 to 13 base pairs, about 10 to 14 base pairs, about 11 to 15 base pairs, about 12 to 16 base pairs, about 13 to 17 base pairs, about 14 to 18 base pairs, about 15 to 19 base pairs, about 16 to 20 base pairs, about 1 to 3 base pairs, about 2 to 4 base pairs, about 3 to 5 base pairs, about 4 to 6 base pairs, about 5 to 7 base pairs, about 6 to 8 base pairs, about 7 to 9 base pairs, about 8 to 10 base pairs, about 9 to 11 base pairs, about 10 to 12 base pairs, about 11 to 13 base pairs, about 12 to 14 base pairs, about 13 to 15 base pairs, about 14 to 16 base pairs, about 15 to 17 base pairs, about 16 to 18 base pairs, about 17 to 19 base pairs, about 18 to 20 base pairs away or upstream of the PAM sequence. In some embodiments, a target nucleobase is about 1, 2, 3, 4, 5, 6, 7, 8, 9, 10, 11, 12, 13, 14, 15, 16, 17, 18, 19, 20, or more base pairs away from or upstream of the PAM sequence. In some embodiments, a target nucleobase is about 1, 2, 3, 4, 5, 6, 7, 8, or 9 base pairs upstream of the PAM sequence. In some embodiments, a target nucleobase is about 2, 3, 4, or 6 base pairs upstream of the PAM sequence.

The fusion protein can comprise more than one heterologous polypeptide. For example, the fusion protein can additionally comprise one or more UGI domains and/or one or more nuclear localization signals. The two or more heterologous domains can be inserted in tandem. The two or more heterologous domains can be inserted at locations such that they are not in tandem in the NapDNAbp.

A fusion protein can comprise a linker between the deaminase and the napDNAbp polypeptide. The linker can be a peptide or a non-peptide linker. For example, the linker can be an XTEN, (GGGS)n (SEQ ID NO: 130), (GGGGS)n (SEQ ID NO: 131), (G)n, (EAAAK)n (SEQ ID NO: 132), (GGS)n, SGSETPGTSESATPES (SEQ ID NO: 55). In some embodiments, the fusion protein comprises a linker between the N-terminal Cas9 fragment and the deaminase. In some embodiments, the fusion protein comprises a linker between the C-terminal Cas9 fragment and the deaminase. In some embodiments, the N-terminal and C-terminal fragments of napDNAbp are connected to the deaminase with a linker. In some embodiments, the N-terminal and C-terminal fragments are joined to the deaminase domain without a linker. In some embodiments, the fusion protein comprises a linker between the N-terminal Cas9 fragment and the deaminase but does not comprise a linker between the C-terminal Cas9 fragment and the deaminase. In some embodiments, the fusion protein comprises a linker between the C-terminal Cas9 fragment and the deaminase but does not comprise a linker between the N-terminal Cas9 fragment and the deaminase.

In other embodiments, the N- or C-terminal fragments of the Cas12 polypeptide comprise a nucleic acid programmable DNA binding domain or a RuvC domain. In other embodiments, the fusion protein contains a linker between the Cas12 polypeptide and the catalytic domain. In other embodiments, the amino acid sequence of the linker is GGSGGS (SEQ ID NO: 168) or GSSGSETPGTSESAT-PESSG (SEQ ID NO: 169). In other embodiments, the linker is a rigid linker. In other embodiments of the above aspects, the linker is encoded by GGAGGCTCTGGAGGAAGC (SEQ ID NO: 170) or GGCTCTTCTGGATCT-GAAACACCTGGCACAAGCGAGAGCGCCACCCCT-GAGAGCTC TGGC (SEQ ID NO: 171).

Fusion proteins comprising a heterologous catalytic domain flanked by N- and C-terminal fragments of a Cas9 or Cas12 polypeptide are also useful for base editing in the methods as described herein. Fusion proteins comprising Cas9 or Cas12 and one or more deaminase domains, e.g., adenosine deaminase, or comprising an adenosine deaminase domain flanked by Cas9 or Cas12 sequences are also useful for highly specific and efficient base editing of target sequences. In an embodiment, a chimeric Cas9 or Cas12 fusion protein contains a heterologous catalytic domain inserted within a Cas12 polypeptide.

In various embodiments, the catalytic domain has DNA modifying activity (e.g., deaminase activity), such as adenosine deaminase activity. In some embodiments, the adenosine deaminase is a TadA (e.g., TadA7.10). In some embodiments, the TadA is a TadA*8. In other embodiments, the fusion protein contains one or more catalytic domains. In other embodiments, at least one of the one or more catalytic domains is inserted within the Cas12 polypeptide or is fused at the Cas12 N-terminus or C-terminus. In other embodiments, at least one of the one or more catalytic domains is inserted within a loop, an alpha helix region, an unstructured portion, or a solvent accessible portion of the Cas12 polypeptide. In other embodiments, the Cas12 polypeptide is Cas12a, Cas12b, Cas12c, Cas12d, Cas12e, Cas12g, Cas12h, or Cas12i. In other embodiments, the Cas12 polypeptide has at least about 85% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 90% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide has at least about 95% amino acid sequence identity to *Bacillus hisashii* Cas12b, *Bacillus thermoamylovorans* Cas12b, *Bacillus* sp. V3-13 Cas12b, or *Alicyclobacillus acidiphilus* Cas12b. In other embodiments, the Cas12 polypeptide contains or consists essentially of a fragment of *Bacillus hisashii* Cas12b, *Bacillus thermoamylovorans* Cas12b, *Bacillus* sp. V3-13 Cas12b, or *Alicyclobacillus acidiphilus* Cas12b.

In other embodiments, the catalytic domain is inserted between amino acid positions 153-154, 255-256, 306-307, 980-981, 1019-1020, 534-535, 604-605, or 344-345 of BhCas12b or a corresponding amino acid residue of Cas12a, Cas12c, Cas12d, Cas12e, Cas12g, Cas12h, or Cas12i. In other embodiments, the catalytic domain is inserted between amino acids P153 and S154 of BhCas12b. In other embodiments, the catalytic domain is inserted between amino acids K255 and E256 of BhCas12b. In other embodiments, the catalytic domain is inserted between amino acids D980 and G981 of BhCas12b. In other embodiments, the catalytic domain is inserted between amino acids K1019 and L1020 of BhCas12b. In other embodiments, the catalytic domain is inserted between amino acids F534 and P535 of BhCas12b. In other embodiments, the catalytic domain is inserted between amino acids K604 and G605 of BhCas12b. In other embodiments, the catalytic domain is inserted between amino acids H344 and F345 of BhCas12b. In other embodiments, catalytic domain is inserted between amino acid positions 147 and 148, 248 and 249, 299 and 300, 991 and 992, or 1031 and 1032 of BvCas12b or a corresponding amino acid residue of Cas12a, Cas12c, Cas12d, Cas12e, Cas12g, Cas12h, or Cas12i. In other embodiments, the catalytic domain is inserted between amino acids P147 and D148 of BvCas12b. In other embodiments, the catalytic domain is inserted between amino acids G248 and G249 of BvCas12b. In other embodiments, the catalytic domain is inserted between amino acids P299 and E300 of BvCas12b. In other embodiments, the catalytic domain is inserted between amino acids G991 and E992 of BvCas12b. In other embodiments, the catalytic domain is inserted between amino acids K1031 and M1032 of BvCas12b. In other embodiments, the catalytic domain is inserted between amino acid positions 157 and 158, 258 and 259, 310 and 311, 1008 and 1009, or 1044 and 1045 of AaCas12b or a corresponding amino acid residue of Cas12a, Cas12c, Cas12d, Cas12e, Cas12g, Cas12h, or Cas12i. In other embodiments, the catalytic domain is inserted between amino acids P157 and G158 of AaCas12b. In other embodiments, the catalytic domain is inserted between amino acids V258 and G259 of AaCas12b. In other embodiments, the catalytic domain is inserted between amino acids D310 and P311 of AaCas12b. In other embodiments, the catalytic domain is inserted between amino acids G1008 and E1009 of AaCas12b. In other embodiments, the catalytic domain is inserted between amino acids G1044 and K1045 at of AaCas12b.

In other embodiments, the fusion protein contains a nuclear localization signal (e.g., a bipartite nuclear localization signal). In other embodiments, the amino acid sequence of the nuclear localization signal is MAPKKKRKVGIHGVPAA (SEQ ID NO: 172). In other embodiments of the above aspects, the nuclear localization signal is encoded by the following sequence:

ATGGCCCCAAAGAAGAAGCG-GAAGGTCGGTATCCACGGAGTCCCAGCAGCC (SEQ ID NO: 173). In other embodiments, the Cas12b polypeptide contains a mutation that silences the catalytic activity of a RuvC domain. In other embodiments, the Cas12b polypeptide contains D574A, D829A and/or D952A mutations. In other embodiments, the fusion protein further contains a tag (e.g., an influenza hemagglutinin tag).

In some embodiments, the fusion protein comprises a napDNAbp domain (e.g., Cas12-derived domain) with an internally fused nucleobase editing domain (e.g., all or a portion of a deaminase domain, e.g., an adenosine deaminase domain). In some embodiments, the napDNAbp is a Cas12b. In some embodiments, the base editor comprises a Cas12 domain (e.g., a BhCas12b domain, a BvCas12b domain, or an AACas12b domain) with an internally fused TadA*8 domain inserted at the loci provided in the below Table 14B.

TABLE 14B

Insertion loci in Cas12b proteins

| | Insertion site | Inserted between aa |
|---|---|---|
| BhCas12b | | |
| position 1 | 153 | PS |
| position 2 | 255 | KE |
| position 3 | 306 | DE |
| position 4 | 980 | DG |
| position 5 | 1019 | KL |
| position 6 | 534 | FP |
| position 7 | 604 | KG |
| position 8 | 344 | HF |
| BvCas12b | | |
| position 1 | 147 | PD |
| position 2 | 248 | GG |
| position 3 | 299 | PE |
| position 4 | 991 | GE |
| position 5 | 1031 | KM |
| AaCas12b | | |
| position 1 | 157 | PG |
| position 2 | 258 | VG |
| position 3 | 310 | DP |
| position 4 | 1008 | GE |
| position 5 | 1044 | GK |

By way of nonlimiting example, an adenosine deaminase (e.g., ABE8.13) may be inserted into a BhCas12b to produce a fusion protein (e.g., ABE8.13-BhCas12b) that effectively edits a nucleic acid sequence, such as a nucleic acid sequence comprising a single nucleotide polymorphism (SNP) associated with sickle cell disease (SCD). In an embodiment the nucleic acid sequence encodes an HBB polypeptide.

Exemplary, yet nonlimiting, fusion proteins are described in U.S. Provisional Application Nos. 62/852,228 and 62/852,224, the contents of which are incorporated by reference herein in their entireties.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1: Adenosine Base Editors with Increased Editing Efficiency

Base editing systems that include a Tad7.10-dCas9 fusion proteins are capable of editing a target polynucleotide with approximately 10-20% efficiency, but for uses requiring higher efficiency their use may be limited. In an effort to identify adenine base editors having increased efficiency and specificity, constructs comprising the adenosine deaminase TadA 7.10 were mutagenized by error prone PCR and subsequently cloned into an expression vector adjacent to a nucleic acid sequence encoding dCas9, a nucleic acid programmable DNA binding protein (FIG. 1A). The expression vectors comprising the adenosine deaminase variants were co-transformed into competent bacterial cells with a selection plasmid encoding chloramphenicol resistance (CamR) and spectinomycin resistance (SpectR) and having a kanamycin resistance gene that was rendered nonfunctional by two point mutations (evolution round 7 strategy) (FIG. 1B). The cells were selected for restoration of kanamycin resistance, which was a read out for adenosine deaminase activity. In subsequent rounds of selection, the expression vectors were co-transformed into competent cells with a plasmid encoding chloramphenicol resistance (CamR) and spectinomycin resistance (SpectR) and having a kanamycin resistance gene that was rendered nonfunctional by three point mutations (evolution round 8 strategy) (FIG. 1C). An inactivated kanamycin resistance gene nucleic acid sequence is provided below:

(SEQ ID NO: 174)
ccggaattgccagctggggcgccctctggtaaggttgggaagccctgcaa agtaaactggatggctttcttgccgccaaggatctgatggcgcaggggat caagatctgatcaagagacaggatgaggat<u>cct</u>ttcgcATGATCGAATAA

GATGGATTGCACGCAGGTTCTCCGGCCGCTTAGGTGGAGCGCCTATT<u>CGG</u>

CTATGACTGGGCACAACAGACAATCGGCTGCTCTGATGCCGCCGTGTTCC

GGCTGTCAGCGCAGGGGCGCCCGGTTCTTTTTGTCAAGACCGACCTGTCC

GGTGCCCTGAATGAACTGCAGGACGAGGCAGCGCGGCTATCGTGGCTGGC

CACGACGGGCGTTCCTTGCGCAGCTGTGCTCGACGTTGTCACTGAAGCGG

GAAGGGACTGGCTGCTATTGGGCGAAGTGCCGGGGCAGGATCTCCTGTCA

TCTCACCTTGCTCCTGCCGAGAAAGTATCCATCATGGCTGATGCAATGCG

GCGGCTGCATACGCTTGATCCGGCTACCTGCCCATTCGACCACCAAGCGA

AACATCGCATCGAGCGAGCACGTACTCGGATGGAAGCCGGTCTTGTCGAT

CAGGATGATCTGGACGAAGAGCATCAGGGGCTCGCGCCAGCCGAACTGTT

CGCCAGGCTCAAGGCGCGCATGCCCGACGGCGAGGATCTCGTCGTGACCC

ATGGCGATGCCTGCTTGCCGAATATCATGGTGGAAAATGGCCGCTTTTCT

GGATTCA*TTAACTGTGGCCGGCT*<u>GGG</u>TGTGGCGGACCGCTATCAGGACAT

AGCGTTGGCTACCCGTGATATTGCTGAAGAGCTTGGCGGCGAATGGGCTG

ACCGCTTCCTCGTGCTTTACGGTATCGCCGCTCCCGATTCGCAGCGCATC

GCCTTCTATCGCCTTCTTGACGAGTTCTTCTAA

In the above sequence, lower case denotes the kanamycin resistance promoter region, bold sequence indicates targeted inactivation portion (Q4* and W15*), the italicized sequence denotes the targeted inactive site of kanamycin resistance gene (D208N), and the underlined sequences denote the PAM sequences.

Again, the cells were plated onto a series of agarose plates with increasing kanamycin concentration. As shown in FIG. 2, adenosine deaminase variants having efficient base editing activity were able to correct the mutations present in the kanamycin resistance gene and were selected for further analysis. Adenosine deaminase variant base editors showing efficient base editing in bacterial cells are described in Table 14. Mammalian expression vectors encoding base editors comprising the selected adenosine deaminase variants were generated.

Hek293T cells expressing a β-globin protein associated with sickle cell disease that contains an E6V (also termed E7V) mutation were used to test the editing efficiency of the adenosine deaminase variants (FIGS. 3A and 3B). These cells termed "Hek293T/HBBE6V" cells were transduced using lentiviral vectors expressing a base editing system that includes a fusion protein comprising the ABE8s listed in Table 15. The ABE8s were generated by cloning an adenosine deaminase variant into a scaffold that included a circular permutant Cas9 and a bipartite nuclear localization sequence. Circular permutant Cas9s are known in the art and described, for example, in Oakes et al., Cell 176, 254-267, 2019. These sequences are provided herein below.

Upregulation of fetal hemoglobin is a therapeutic approach to overcoming sickle cell disease. FIG. 3A shows a therapeutically relevant site for upregulation of fetal hemoglobin. Editing adenosines at residues 5 and 8 can significantly reduce BCL11A binding, thereby increasing expression of fetal hemoglobin. Referring to FIG. 3A, the ABE8s exhibited approximately 2-3 fold more base editing activity than the base editor ABE7.10.

TABLE 15

Novel Adenine Base Editors ABE8

| plasmid ID | description | function |
|---|---|---|
| 280 | ABE8.1 | monomer_TadA*7.10 + Y147T |
| 281 | ABE8.2 | monomer_TadA*7.10 + Y147R |
| 282 | ABE8.3 | monomer_TadA*7.10 + Q154S |
| 283 | ABE8.4 | monomer_TadA*7.10 + Y123H |
| 284 | ABE8.5 | monomer_TadA*7.10 + V82S |
| 285 | ABE8.6 | monomer_TadA*7.10 + T166R |
| 286 | ABE8.7 | monomer_TadA*7.10 + Q154R |

TABLE 15-continued

Novel Adenine Base Editors ABE8

| plasmid ID | description | function |
|---|---|---|
| 287 | ABE8.8 | monomer, Y147R_Q154R_Y123H |
| 288 | ABE8.9 | monomer, Y147R_Q154R_I76Y |
| 289 | ABE8.10 | monomer, Y147R_Q154R_T166R |
| 290 | ABE8.11 | monomer, Y147T_Q154R |
| 291 | ABE8.12 | monomer, Y147T_Q154S |
| 292 | ABE8.13 | monomer_H123Y123H_Y147R_Q154R_I76Y |
| 293 | ABE8.14 | heterodimer_TadA*7.10 + Y147T |
| 294 | ABE8.15 | heterodimer_TadA*7.10 + Y147R |
| 295 | ABE8.16 | heterodimer_TadA*7.10 + Q154S |
| 296 | ABE8.17 | heterodimer_TadA*7.10 + Y123H |
| 297 | ABE8.18 | heterodimer_TadA*7.10 + V82S |
| 298 | ABE8.19 | heterodimer_TadA*7.10 + T166R |
| 299 | ABE8.20 | heterodimer_TadA*7.10 + Q154R |
| 300 | ABE8.21 | heterodimer_Y147R_Q154R_Y123H |
| 301 | ABE8.22 | heterodimer_Y147R_Q154R_I76Y |
| 302 | ABE8.23 | heterodimer_Y147R_Q154R_T166R |
| 303 | ABE8.24 | heterodimer_Y147T_Q154R |
| 304 | ABE8.25 | heterodimer_Y147T_Q154S |

Referring to FIG. 4, the ABE8s were introduced into Hek293T/HBBE6V cells along with 18, 19, 20, 21, or 22 nucleotide guide RNAs targeting the polynucleotide encoding HBB E6V. The ABE8 editors showed increased editing efficiency when fused to circular permutant (Cp)-Cas9. In total, 40 different ABE8 constructs (Table 16) and three ABE7.10 constructs were tested for editing activity in Hek293T/HBBE6V cells. The sequence of exemplary constructs follows. To evaluate the specificity of editing, target and unintended or bystander mutations were monitored (FIG. 5). Unintended editing of an adenosine in codon 5 was silent. However, unintended editing of codon 9 resulted in a serine to proline mutation. Referring again to FIG. 5, multiple ABE8s showed increased editing efficiency and specificity compared to the ABE7.10 editors, and none of the editors had significant bystander editing that led to the serine to proline missense mutation.

Further analysis of selected ABE8s and an ABE7.10 control was carried out in fibroblast cells containing the sickle cell mutation. As shown in FIG. 6, the ABE8 editors had increased base editing activity compared to the ABE7.10. ABE8.18 showed approximately 70% efficiency. The selected ABE8 editors also displayed unprecedented specificity. Importantly, the average INDEL formation for all ABE8 editors was less than 0.1%.

TABLE 16

| plasmid ID | description | function |
|---|---|---|
| 335 | NGC PAM CP5 variant (S. pyogenes Cas9)_ABE8.1 | monomer_TadA*7.10 + Y147T |
| 336 | NGC PAM CP5 variant (S. pyogrouns Cas9)_ABE8.2 | monomer_TadA*7.10 + Y147R |
| 337 | NGC PAM CP5 variant (S. pyogenes Cas9)_ABE8.3 | monomer_TadA*7.10 + Q154S |
| 338 | NGC PAM CP5 variant (S. pyogenes Cas9)_ABE8.4 | monomer_TadA*7.10 + Y123H |
| 339 | NGC PAM CP5 variant (S. pyogenes Cas9)_ABE8.5 | monomer_TadA*7.10 + V82S |
| 340 | NGC PAM CP5 variant (S. pyogenes Cas9)_ABE8.6 | monomer_TadA*7.10 + T166R |
| 341 | NGC PAM CP5 variant (S. pyogenes Cas9)_ABE8.7 | monomer_TadA*7.10 + Q154R |
| 342 | NGC PAM CP5 variant (S. pyogenes Cas9)_ABE8.8 | monomer, Y147R_Q154R_Y123H |
| 343 | NGC PAM CP5 variant (S. pyogenes Cas9)_ABE8.9 | monomer, Y147R_Q154R_I76Y |
| 344 | NGC PAM CP5 variant (S. pyogenes Cas9)_ABE8.10 | monomer, Y147R_Q154R_T166R |
| 345 | NGC PAM CP5 variant (S. pyogenes Cas9)_ABE8.11 | monomer, Y147T_Q154R |
| 346 | NGC PAM CP5 variant (S. pyogenes Cas9)_ABE8.12 | monomer, Y147T_Q154S |
| 347 | NGC PAM CP5 variant (S. pyogenes Cas9)_ABE8.13 | monomer_H123Y123H_Y147R_Q154R_I76Y |
| 348 | NGC PAM CP5 variant (S. pyogenes Cas9)_ABE7.10 | monomer_deletion at TadA7.10* residue 149 |
| 349 | NGC PAM CP5 variant (S. pyogenes Cas9)_ABE7.10 | monomer_deletion at TadA7.10* residue 150 |
| 350 | NGC PAM CP5 variant (S. pyogenes Cas9)_ABE7.10 | monomer_deletion at TadA7.10* residue 151 |
| 351 | NGC PAM CP5 variant (S. pyogenes Cas9)_ABE7.10 | monomer_deletion at TadA7.10* residue 152 |
| 352 | NGC PAM CP5 variant (S. pyogenes Cas9)_ABE7.10 | monomer_deletion at TadA7.10* residue 153 |
| 353 | NGC PAM CP5 variant (S. pyogenes Cas9)_ABE7.10 | monomer_deletion at TadA7.10* residue 154 |
| 354 | NGC PAM CP5 variant (S. pyogenes Cas9)_ABE7.10 | monomer_deletion at TadA7.10* residue 155 |
| 355 | NGC PAM CP5 variant (S. pyogenes Cas9)_ABE7.10 | monomer_deletion at TadA7.10* residue 156 |
| 356 | NGC PAM CP5 variant (S. pyogenes Cas9)_ABE7.10 | monomer_deletion at TadA7.10* residue 157 |
| 357 | NGC PAM CP5 variant (S. pyogenes Cas9)_ABE8.14 | heterodimer_TadA*7.10 + Y147T |
| 358 | NGC PAM CP5 variant (S. pyogenes Cas9)_ABE8.15 | heterodimer_TadA*7.10 + Y147R |
| 359 | NGC PAM CP5 variant (S. pyogenes Cas9)_ABE8.16 | heterodimer_TadA*7.10 + Q154S |
| 360 | NGC PAM CP5 variant (S. pyogenes Cas9)_ABE8.17 | heterodimer_TadA*7.10 + Y123H |
| 361 | NGC PAM CP5 variant (S. pyogenes Cas9)_ABE8.18 | heterodimer_TadA*7.10 + V82S |
| 362 | NGC PAM CP5 variant (S. pyogenes Cas9)_ABE8.19 | heterodimer_TadA*7.10 + T166R |
| 363 | NGC PAM CP5 variant (S. pyogenes Cas9)_ABE8.20 | heterodimer_TadA*7.10 + Q154R |
| 364 | NGC PAM CP5 variant (S. pyogenes Cas9)_ABE8.21 | heterodimer_Y147R_Q154R_Y123H |
| 365 | NGC PAM CP5 variant (S. pyogenes Cas9)_ABE8.22 | heterodimer_Y147R_Q154R_I76Y |
| 366 | NGC PAM CP5 variant (S. pyogenes Cas9)_ABE8.23 | heterodimer_Y147R_Q154R_T166R |
| 367 | NGC PAM CP5 variant (S. pyogenes Cas9)_ABE8.24 | heterodimer_Y147T_Q154R |

TABLE 16-continued

| plasmid ID | description | function |
|---|---|---|
| 368 | NGC PAM CP5 variant (S. pyogenes Cas9)_ABE8.25 | heterodimer_Y147T_Q154S |
| 369 | NGC PAM CP5 variant (S. pyogenes Cas9)_ABE8.26 | heterodimer_H123Y123H_Y147R_Q154R_I76Y |
| 370 | NGC PAM CP5 variant (S. pyogenes Cas9)_ABE7.10 | heterodimer_deletion at TadA7.10* residue 149 |
| 371 | NGC PAM CP5 variant (S. pyogenes Cas9)_ABE7.10 | heterodimer_deletion at TadA7.10* residue 150 |
| 372 | NGC PAM CP5 variant (S. pyogenes Cas9)_ABE7.10 | heterodimer_deletion at TadA7.10* residue 151 |
| 373 | NGC PAM CP5 variant (S. pyogenes Cas9)_ABE7.10 | heterodimer_deletion at TadA7.10* residue 152 |
| 374 | NGC PAM CP5 variant (S. pyogenes Cas9)_ABE7.10 | heterodimer_deletion at TadA7.10* residue 153 |
| 375 | NGC PAM CP5 variant (S. pyogenes Cas9)_ABE7.10 | heterodimer_deletion at TadA7.10* residue 154 |
| 376 | NGC PAM CP5 variant (S. pyogenes Cas9)_ABE7.10 | heterodimer_deletion at TadA7.10* residue 155 |
| 377 | NGC PAM CP5 variant (S. pyogenes Cas9)_ABE7.10 | heterodimer_deletion at TadA7.10* residue 156 |
| 378 | NGC PAM CP5 variant (S. pyogenes Cas9)_ABE7.10 | heterodimer_deletion at TadA7.10* residue 157 |

Example 2: Adenine Base Editors for the Treatment of Hematological Disorders

Sickle cell disease (SCD) affects approximately 100,000 patients in the United States. Individuals carrying both the SCD mutation and mutations that cause persistence of fetal hemoglobin (HPFH) do not typically present with sickle cell pathologies due to persistent fetal hemoglobin (HbF) levels. Higher HbF levels correlate with greater benefit for individuals with blood disease, such as reduction in disease symptoms and improved overall health. A T to C mutation at the −198 position in the HGB promoter causes HPFH by interference of binding to γ-globulin repressor proteins, such as BCL11A.

ABE8 constructs were evaluated in human hematopoietic stem cells (HSC). Ex vivo manipulation and/or editing of HSCs prior to administration to patients as a cell therapy is a promising approach for the treatment of hematological disorders. It has been previously demonstrated that ABEs can introduce a T to C substitution at the −198 position of the promoter region of HBG1/2 (Gaudelli, N. M. et al. Programmable base editing of A*T to G*C in genomic DNA without DNA cleavage. Nature 551, 464-471, doi:10.1038/nature24644 (2017)). This naturally occurring allele yields Hereditary Persistence of Fetal Hemoglobin (HPFH) resulting in increased levels of γ-globin into adulthood, which can mitigate the defects in β-globin seen in sickle cell disease and β-thalassemia (Wienert, B. et al. KLF1 drives the expression of fetal hemoglobin in British HPFH. Blood 130, 803-807, doi:10.1182/blood-2017-02-767400 (2017)). With the goal of reproducing the HPFH phenotype and evaluating the clinical relevance of ABE8, CD34+ hematopoietic stem cells were isolated from two donors and transfected with mRNA encoding ABE8 editors and end-modified sgRNA placing the target A at position 7 within the protospacer.

The average ABE8 editing efficiencies at the −198 HBG1/2 promoter target site were 2-3 times higher than either ABE7.10 construct at early time points (48h), and 1.3-2-fold higher than ABE7.10 at the later time (144h) (FIG. 7B; FIGS. 8A and 8B, FIG. 9). FIG. 7A schematically shows the HBG1/2 promoter target site. FIG. 7C shows that ABE8 editing in CD34+ cells yielded an approximately 1.4-fold increase in γ-globin formation in differentiated erythrocytes (ABE8.13-d resulted in 55% γ-globin/α-globin expression). These kinetic distinctions are clinically important for ex vivo therapies in which cell culturing must be kept to a minimum prior to administration of cell therapy.

Next, the amount of γ-globin protein produced following ABE treatment and erythrocyte differentiation was quantified by UPLC (FIGS. 10-30). A 3.5-fold average increase in % γ-globin/α-globin expression was observed in erythrocytes derived from the ABE8 treatment groups when compared to mock treated cells and about a 1.4-fold increase was observed when ABE8.13-d was compared to levels achieved with ABE7.10-m/d (FIG. 7B).

The editing efficiencies and on-target editing (e.g., at nucleotide position 9G in the sickle cell (HbS) allele) by ABE8 editors is further demonstrated in FIGS. 37, 40, 43A, 43B, 44A and 44B.

It is predicted that ≥20% HbF is required to ameliorate symptoms of sickle cell disease, and β-thalassemia patients are likely to require even higher minimum levels (see e.g., Canver, M. C. & Orkin, S. H. Customizing the genome as therapy for the beta-hemoglobinopathies. Blood 127, 2536-2545, doi:10.1182/blood-2016-01-678128 (2016); Fitzhugh, C. D. et al., Blood, 130, 1946-1948, doi:10.1182/blood-2017-03-772392 (2017)). The γ-globin levels observed following ABE8 treatment surpassed this threshold for HbF level.

Overall, ABE8s recreated a naturally-occurring hereditary persistence of fetal hemoglobin (HPFH) allele at the promoter of the γ-globin genes HBG1 and HBG2, achieving editing efficiencies of up to 60% in human CD34+ cell cultures and a corresponding upregulation of gamma globin expression in differentiated erythrocytes. (FIGS. 34A. 34B. 35A-35C)

Example 3: Complementary Base Editing Approaches for the Treatment of Sickle Cell Disease and Beta Thalassemia (β-Thalassemia)

Sickle cell disease (SCD) and Beta thalassemia are disorders of beta globin production and function that lead to severe anemia and significant disease complications across a multitude of organ systems. Autologous transplantation of hematopoietic stem cells engineered through the upregulation of fetal hemoglobin (HbF) or correction of the beta globin gene have the potential to reduce disease burden in patients with beta hemoglobinopathies. Base editing is a recently developed technology that enables precise modification of the genome without the introduction of double strand DNA breaks.

Gamma globin gene promoters were comprehensively screened with cytosine and adenine base editors (ABE) for the identification of alterations that would derepress HbF. Three regions were identified that significantly upregulated HbF, and the most effective nucleotide residue conversions are supported by natural variation seen in patients with hereditary persistence of fetal hemoglobin (HPFH). ABEs have been developed that significantly increase the level of HbF following nucleotide conversion at key regulatory motifs within the HBG1 and HBG2 (HBG1/2) promoters. CD34+ hematopoietic stem and progenitor cells (HSPC) were purified at clinical scale and edited using a process designed to preserve self-renewal capacity. Editing at two independent sites with different ABEs reached 94 percent and resulted in up to 63 percent gamma globin by UPLC (FIGS. 31A-31E). The levels of HbF observed should afford protection to the majority of SCD and β-thalassemia patients based on clinical observations of HPFH and non-interventional therapy that links higher HbF dosage with milder disease (Ngo et al., 2011 *Brit J Hem*, Vol. 156(2):259-264; Musallam et al., 2012 Blood). Accordingly, in the HPFH approach described here, base editing is used to recreate single base changes in the regulatory region of both gamma globin genes (HBG1 and HBG2) that disrupt repressor binding and lead to increased expression of fetal hemoglobin (HbF). Beta-thalassemia or sickle cell disease patients naturally harboring these variants are often asymptomatic or experience a milder form of the disease. Base editing followed by in vitro erythroid differentiation of CD34+ cells from both healthy donors and sickle trait donors led to HbF levels of greater than 60%, which is expected to be clinically relevant.

Hb G-Makassar

Directly correcting the Glu6Val mutation of SCD has been a recent goal of genetic therapies designed for the SCD population. Current base editing technology cannot yet convert mutations like those that result from the A-T transversion in sickle beta globin; however, ABE variants have been designed to recognize and edit the opposite stranded adenine residue of valine. This results in the conversion of valine to alanine and the production of a naturally occurring variant known as Hb G-Makassar. Beta globin with alanine at this position does not contribute to polymer formation, and patients with Hb G-Makassar are asymptomatic in that they present with normal hematological parameters and red blood cell morphology.

ABE base editors, such as the ABE8s described herein (see, e.g., Table 7, Table 14 and FIGS. 36A-36C; 37-39) were used to directly convert the sickle cell disease-causing point mutation (E6V) into an asymptomatic, naturally-occurring variant (E6A), also known as Hb G-Makassar. Individuals harboring the Hb G-Makassar variant do not have polymerization (sickling) and are otherwise asymptomatic. SCD patient fibroblasts edited with these ABE variants achieve up to 70 percent conversion of the target adenine (FIG. 32A). CD34+ cells from healthy donors were then edited with a lead ABE variant, targeting a synonymous mutation in an adjacent proline that resides within the editing window and serves as a proxy for editing the SCD mutation. The average editing frequency was 40 percent (FIG. 32B). In addition, greater than 50% of base editing at position 9G was achieved at 96 hours post-electroporation. (FIG. 40. FIGS. 43A and 43B; and FIGS. 44A and 44B). Donor myeloid chimerism documented at these levels in the allogeneic transplant setting exceeds the 20 percent that is required for reversing the sickle phenotype (Fitzhugh et al, 2017 Blood).

Following base editing of the HbS target site with base editors comprising adenosine deaminase variants, e.g., ABE8, as described herein using cells (CD34+) from an SCD patient sample (homozygous or heterozygous HbSS samples) and analysis of the edited sample by UHPLC, distinct peaks delineated the Hb-G-Makassar variant globin from the HbS globin variant (FIGS. 41A, 45, 46A and 47), which resulted from direct conversion of the sickle cell disease-causing point mutation (E6V) into an asymptomatic, naturally-occurring variant (E6A) in the cells. Based on molecular weights in an edited heterozygous sample, the different beta globin (Hb) variants that corresponded to the Val→Ala substitution were distinguishable by UHPLC. LC-MS analysis of the edit peak also showed the presence of the distinct beta globin variants. (FIGS. 41B, 46B and 47B). The UHPLC and LC-MS analyses detected editing from the mutant HbS sickle cell point mutation (E6V) to the asymptomatic Hb G-Makassar variant (E6A), thus demonstrating successful editing of a pathogenic sickle cell variant (HbS) to the asymptomatic, nonpathogenic Hb G-Makassar variant.

For HPFH editing studies, a suitable gRNA sequence (5' to 3') is represented by the following sequence:

(SEQ ID NO: 175)
mCsmUsmUsGACCAAUAGCCUUGACAGUUUUAGAGCUAGAAAUAGCAAGU

UAAAAUAAGGCUAGUCCGUUAUCAACUUGAAAAAGUGGCACCGAGUCGGU

GCUsmUsmUsmU

In the above sequence, modifications are as follows: "mC" is 2'-O-methylcytidine; "mU" is 2'-O-methyluradine; and "s" indicates position of a phosphorothioate. It will be appreciated that the code for modifications is not standard. Accordingly, separate codes are typically used for the Makassar and the HPFH sgRNA guide sequences. Alternatively, the HPFH sequence with the same nomenclature as that of the Makassar sequence is as follows:

(SEQ ID NO: 176)
csususGACCAAUAGCCUUGACAGUUUUAGAGCUAGAAAUAGCAAGUUAA

AAUAAGGCUAGUCCGUUAUCAACUUGAAAAAGUGGCACCGAGUCGGUGCU sususu

The target sequence, including edited bases 5 and 8 (in bold) and PAM (SEQ ID NO: 177):

| 1 | 2 | 3 | 4 | 5 | 6 | 7 | 8 | 9 | 10 | 11 | 12 | 13 | 14 | 15 | 16 | 17 | 18 | 19 | 20 | PAM |
|---|---|---|---|---|---|---|---|---|----|----|----|----|----|----|----|----|----|----|----|-----|
| C | T | T | G | A | C | C | A | A | T | A | G | C | C | T | T | G | A | C | A | AGG |

Example 4: Reduction of HbS and Upregulation of HbF in SCD CD34+ Cells

CD34+ cells from a patient having SCD were transfected with ABE8.8 mRNA and sgRNA (HBG1/2, 50 nM) using electroporation. Edited cells were differentiated to erythroid cells in vitro. The editing rate at HBG1/2 promoters was measured by Next-Genome Sequencing (NGS). 16.5% editing by the ABE8.8 base editor was observed at 48 hours post differentiation, and 89.2% editing was measured on day 14 post differentiation (FIG. 34A). The breakdown of bystander editing at 48 hours and on day 14 post-differentiation is also shown (FIG. 34B).

The functional readout of HbF upregulation and HbS downregulation in SCD CD34+ cells subjected to editing is shown in FIGS. 35A-35D. Edited SCD CD34+ cells were differentiated to erythroid cells and globin levels were analyzed on day 18 post differentiation. Globin levels in erythroid cells differentiated from unedited SCD CD34+ cells were assessed by UHPLC. FIG. 35B shows globin levels in erythroid cells differentiated from edited SCD CD34+ cells. 63.2% of γ globin level was detected in erythroid cells differentiated from edited SCD CD34+ cells versus unedited cells (FIG. 35C). S globin was reduced from 86% to 32.9% differentiated from edited SCD CD34+ cells versus unedited cells (FIG. 35D). The upregulation of fetal hemoglobin is an approach that is advantageous for the treatment of SCD as well as beta-thalassemia.

Example 5: Materials and Methods

General Methods:

All cloning was conducted via USER enzyme (New England Biolabs) cloning methods (see Geu-Flores et al., USER fusion: a rapid and efficient method for simultaneous fusion and cloning of multiple PCR products. *Nucleic Acids Res* 35, e55, doi:10.1093/nar/gkm106 (2007)) and templates for PCR amplification were purchased as bacterial or mammalian codon optimized gene fragments (GeneArt). Vectors created were transformed into Mach T1$^R$ Competent Cells (ThermoFisher Scientific) and maintained at −80 C for long-term storage. All primers used in this work were purchased from Integrated DNA Technologies and PCRS were carried out using either Phusion U DNA Polymerase Green MultiPlex PCR Master Mix (ThermoFisher) or Q5 Hot Start High-Fidelity 2x Master Mix (New England Biolabs). All plasmids used in this work were freshly prepared from 50 mL of Mach1 culture using ZymoPURE Plasmid Midiprep (Zymo Research Corporation) which involves an endotoxin removal procedure. Molecular biology grade, Hyclone water (GE Healthcare Life Sciences) was used in all assays, transfections, and PCR reactions to ensure exclusion of DNAse activity.

Amino acid sequences of sgRNAs used for Hek293T mammalian cell transfection are provided in Table 17 below. The 20-nt target protospacer is shown in bold font. When a target DNA sequence did not start with a 'G,' a 'G' was added to the 5' end of the primer since it has been established that the human U6 promoter prefers a 'G' at the transcription start site (see Cong, L. et al., Multiplex genome engineering using CRISPR/Cas systems. Science 339, 819-823, doi: 10.1126/science.1231143 (2013)). The pFYF sgRNA plasmid described previously was used as a template for PCR amplification.

TABLE 17

Sequences of sgRNAs used for Hek293T mammalian cell transfection.

| Site | RNA protospacer sequence | Cas9 scaffold | PAM |
|---|---|---|---|
| 1 | GAACACAAAGCAUAGACUGC (SEQ ID NO: 178) | S. pyogenes | NGG |
| 2 | GGGAAAGACCCAGCAUCCGU (SEQ ID NO: 179) | S. pyogenes | NGG |
| 3 | GCUCCCAUCACAUCAACCGG (SEQ ID NO: 180) | S. pyogenes | NGG |
| 4 | GGUGAGUGAGUGUGUGCGUG (SEQ ID NO: 181) | S. pyogenes | NGG |
| 5 | GGCUUCAGGUUCUAAAUGAG (SEQ ID NO: 182) | S. pyogenes | NGG |
| 6 | GCAGAGAGUCGCCGUCUCCA (SEQ ID NO: 183) | S. pyogenes | NGG |
| 7 | GUGUAAGACCUCAAAAGCAC (SEQ ID NO: 184) | S. pyogenes | NGG |
| 8 | GAUGAGAAGGAGAAGUUCUU (SEQ ID NO: 185) | S. pyogenes | NGG |
| 9 | GAGGACAAAGUACAAACGGC (SEQ ID NO: 186) | S. pyogenes | AGA |
| 10 | GCCACCACAGGGAAGCUGGG (SEQ ID NO: 187) | S. pyogenes | TGA |
| 11 | GCUCUCAGGCCCUGUCCGCA (SEQ ID NO: 188) | S. pyogenes | CGT |
| 12 | GAGCAAAUACCAGAGAUAAG (SEQ ID NO: 189) | S. pyogenes | AGA |
| 13 | GAUCAGGAAAUAGAGCCACA (SEQ ID NO: 190) | S. pyogenes | GGC |
| 14 | GCCCAUCCCUGAGUCCAGCG (SEQ ID NO: 191) | S. pyogenes | AGC |
| 15 | GAACACGAAGACAUCUGAAGGUA (SEQ ID NO: 192) | S. aureus | TTGAAT |

TABLE 17-continued

Sequences of sgRNAs used for Hek293T mammalian cell transfection.

| Site | RNA protospacer sequence | Cas9 scaffold | PAM |
|---|---|---|---|
| 16 | GAUUUACAGCCUGGCCUUUGGGG (SEQ ID NO: 193) | S. aureus | TCGGGT |
| 17 | GGAGAGAAAGAGAAGUUGAUUG (SEQ ID NO: 194) | S. aureus | ATGGGT |
| 18 | GAGGGUGAGGGAUGAGAUAAUG (SEQ ID NO: 195) | S. aureus | ATGAGT |
| 19 | GGUGGAGGAGGGUGCAUGGGGU (SEQ ID NO: 196) | S. aureus | CAGAAT |
| 20 | GCUGUUGCAUGAGGAAAGGGAC (SEQ ID NO: 197) | S. aureus | TAGAGT |
| HEK2 | GAACACAAAGCAUAGACUGC (SEQ ID NO: 178) | S. pyogenes | CGG |
| HEK3 | GGCCCAGACUGAGCACGUGA (SEQ ID NO: 198) | S. pyogenes | TGG |
| HEK4 | GGCACUGCGGCUGGAGGUGG (SEQ ID NO: 199) | S. pyogenes | GGG |
| LDLR | GCAGAGCACUGGAAUUCGUCA (SEQ ID NO: 200) | S. pyogenes | GGG | sgRNA scaffold sequences are as follows:
S. pyogenes:

(SEQ ID NO: 201)
GUUUUAGAGCUAGAAAUAGCAAGUUAAAAUAAGGCUAGUCCGUUAUCAAC

UUGAAAAAGUGGCACCGAGUCGGUGC

S. aureus:

(SEQ ID NO: 202)
GUUUUAGUACUCUGUAAUGAAAAUUACAGAAUCUACUAAAACAAGGCAA
AAUGCCGUGUUUAUCUCGUCAACUUGUUGGCGAGA

Generation of Input Bacterial TadA* Libraries for Directed Evolution

The TadA*8.0 library was designed to encode all 20 amino acids at each amino acid position in the TadA*7.10 open reading frame (Gaudelli, N. M. et al., Programmable base editing of A*T to G*C in genomic DNA without DNA cleavage. Nature 551, 464-471, doi:10.1038/nature24644 (2017)). Each TadA*8.0 library member contained about 1-2 new coding mutations and was chemically synthesized and purchased from Ranomics Inc (Toronto, Canada). The TadA*8.0 library was PCR amplified with Phusion U Green MultiPlex PCR Master Mix and USER-assembled into a bacterial vector optimized for ABE directed evolution (Gaudelli, N. M. et al., Programmable base editing of A*T to G*C in genomic DNA without DNA cleavage. Nature 551, 464-471, doi:10.1038/nature24644 (2017)).

Bacterial Evolution of TadA Variants

Directed evolution of ABE containing the TadA*8 library was conducted as previously described (Gaudelli, N. M. et al., Programmable base editing of A*T to G*C in genomic DNA without DNA cleavage. Nature 551, 464-471, doi: 10.1038/nature24644 (2017)) with the following changes: i) E. coli 10 betas (New England Biolabs) were used as the evolution host; and ii) survival on kanamycin relied on correction of three genetic inactivating components (e.g. survival required reversion of two stop mutations and one active site mutation in kanamycin). The kanamycin resistance gene sequence contains selection mutations for ABE8 evolution. After overnight co-culturing of selection plasmid and editor in 10 beta host cells, the library cultures were plated on 2xYT-agar medium supplemented with plasmid maintenance antibiotic and increasing concentrations of selection antibiotic, kanamycin (64-512 µg/mL). Bacteria were allowed to grow for 1 day and the TadA*8 portion of the surviving clones were Sanger sequenced after enrichment. Identified TadA*8 mutations of interest were then were then incorporated into mammalian expression vector via USER assembly.

General HEK293T and RPMI-8226 Mammalian Culture Conditions

Cells were cultured at 37° C. with 5% $CO_2$. HEK293T cells [CLBTx013, American Type Cell Culture Collection (ATCC)] were cultured in Dulbecco's modified Eagles medium plus Glutamax (10566-016, Thermo Fisher Scientific) with 10% (v/v) fetal bovine serum (A31606-02, Thermo Fisher Scientific). RPMI-8226 (CCL-155, ATCC) cells were cultured in RPMI-1640 medium (Gibco) with 10% (v/v) fetal bovine serum (Gibco). Cells were tested negative for mycoplasma after receipt from supplier.

Hek293T Plasmid Transfection and gDNA Extraction

HEK293T cells were seeded onto 48-well well Poly-D-Lysine treated BioCoat plates (Corning) at a density of 35,000 cells/well and transfected 18-24 hours after plating. Cells were counted using a NucleoCounter NC-200 (Chemometec). To these cells were added 750 ng of base editor or nuclease control, 250 ng of sgRNA, and 10 ng of GFP-max plasmid (Lonza) diluted to 12.5 µL total volume in Opti-MEM reduced serum media (ThermoFisher Scientific). The solution was combined with 1.5 µL of Lipofectamine 2000 (ThermoFisher) in 11 µL of Opti-MEM reduced serum media and left to rest at room temperature for 15 min. The entire 25 µL mixture was then transferred to the pre-seeded Hek293T cells and left to incubate for about 120 h. Following incubation, media was aspirated and cells were washed two times with 250 µL of 1× PBS solution (ThermoFisher Scientific) and 100 µL of freshly prepared lysis buffer was added (100 mM Tris-HCl, pH 7.0, 0.05% SDS, 25 µg/mL Proteinase K (Thermo Fisher Scientific). Transfection plates containing lysis buffer were incubated at 37° C. for 1 hour and the mixture was transferred to a 96-well PCR plate and heated at 80° C. for 30 min.

Analysis of DNA and RNA Off-Target Editing for ABE Architecture and ABE8 Constructs HEK293T cells were plated on 48-well poly-D-lysine coated plates (Corning) 16 to 20 hours before lipofection at a density of 30,000 cells per well in DMEM+Glutamax medium (Thermo Fisher Scientific) without antibiotics. 750 ng nickase or base editor expression plasmid DNA was combined with 250 ng of sgRNA expression plasmid DNA in 15 µl OPTIMEM+Glutamax. This was combined with 10 µl of lipid mixture, comprising 1.5 µl Lipofectamine 2000 and 8.5 µl OPTIMEM+Glutamax per well. Cells were harvested 3 days after transfection and either DNA or RNA was harvested. For DNA analysis, cells were washed once in 1×PBS, and then lysed in 100 µl QuickExtract™ Buffer (Lucigen) according to the manufacturer's instructions. For RNA harvest, the MagMAX™ mirVana™ Total RNA Isolation Kit (Thermo Fisher Scientific) was used with the KingFisher™ Flex Purification System according to the manufacturer's instructions.

Targeted RNA sequencing was performed largely as previously described (see Rees, H. A. et al., Analysis and minimization of cellular RNA editing by DNA adenine base editors. Sci Adv 5, eaax5717, doi:10.1126/sciadv.aax5717 (2019)). cDNA was prepared from the isolated RNA using the SuperScript IV One-Step RT-PCR System with EZDnase (Thermo Fisher Scientific) according to the manufacturer's instructions. The following program was used: 58° C. for 12 min; 98° C. for 2 min; followed by PCR cycles which varied by amplicon: for CTNNB1 and IP90: 32 cycles of [98° C. for 10 sec; 60° C. for 10 sec; 72° C. for 30 sec] and for RSL1D135 cycles of [98° C. for 10 sec; 58° C. for 10 sec; 72° C. for 30 sec]. No RT controls were run concurrently with the samples. Following the combined RT-PCR, amplicons were barcoded and sequenced using an Illumina Miseq as described above. The first 125nt in each amplicon, beginning at the first base after the end of the forward primer in each amplicon, was aligned to a reference sequence and used for mean and maximum A-to-I frequencies in each amplicon (FIGS. 33A and 33B).

Off-target DNA sequencing was performed using previously published primers (see Komor, A. C. et al., Programmable editing of a target base in genomic DNA without double-stranded DNA cleavage. Nature 533, 420-424, doi:10.1038/nature17946 (2016); Rees, H. A. et al., Analysis and minimization of cellular RNA editing by DNA adenine base editors. Sci Adv 5, eaax5717, doi:10.1126/sciadv.aax5717 (2019)) listed in Table 18 below using a two-step PCR and barcoding method to prepare samples for sequencing using Illumina Miseq sequencers as above.

TABLE 18

| HTS Primers used to amplify genomic sites: | |
|---|---|
| Primer Name | Sequence |
| fwd_site_1 | ACACTCTTTCCCTACACGACGCTCTTCCGATCTNNNNCCAGCCCCATCTGTCAAACT (SEQ ID NO: 203) |
| rev_site_1 | TGGAGTTCAGACGTGTGCTCTTCCGATCTTGAATGGATTCCTTGGAAACAATGA (SEQ ID NO: 204) |
| fwd_site_2 | ACACTCTTTCCCTACACGACGCTCTTCCGATCTNNNNTGAGGGAGAGCCGTGTAGTT (SEQ ID NO: 205) |
| rev_site_2 | TGGAGTTCAGACGTGTGCTCTTCCGATCTGCCTCTCAAAGTGCTGGGAT (SEQ ID NO: 206) |
| fwd_site_3 | ACACTCTTTCCCTACACGACGCTCTTCCGATCTNNNNCCATCAGGCTCTCAGCTCAG (SEQ ID NO: 207) |
| rev_site_3 | TGGAGTTCAGACGTGTGCTCTTCCGATCTCTCGTGGGTTTGTGGTTGC (SEQ ID NO: 208) |
| fwd_site_4 | ACACTCTTTCCCTACACGACGCTCTTCCGATCTNNNNGCCCATTCCCTCTTTAGCCA (SEQ ID NO: 209) |
| rev_site_4 | TGGAGTTCAGACGTGTGCTCTTCCGATCTGAGCCGTTCCCTCTTTGCTA (SEQ ID NO: 210) |
| fwd_site_5 | ACACTCTTTCCCTACACGACGCTCTTCCGATCTNNNNAACCTGTGTGACACTTGGCA (SEQ ID NO: 211) |
| rev_site_5 | TGGAGTTCAGACGTGTGCTCTTCCGATCTGTCTGGCCCAAGATCACACA (SEQ ID NO: 212) |
| fwd_site_6 | ACACTCTTTCCCTACACGACGCTCTTCCGATCTNNNCACGGATAAAGACGCTGGGA (SEQ ID NO: 213) |
| rev_site_6 | TGGAGTTCAGACGTGTGCTCTTCCGATCTGGGGTCCCAGGTGCTGAC (SEQ ID NO: 214) |
| fwd_site_7 | ACACTCTTTCCCTACACGACGCTCTTCCGATCTNNNTTGATTGTCTCCTTTGCCGC (SEQ ID NO: 215) |

TABLE 18-continued

HTS Primers used to amplify genomic sites:

| Primer Name | Sequence |
|---|---|
| rev_site_7 | TGGAGTTCAGACGTGTGCTCTTCCGATCTTGACCCAGTGTTTGATAGATCAGT (SEQ ID NO: 216) |
| fwd_site_8 | ACACTCTTTCCCTACACGACGCTCTTCCGATCTNNNCACCCCTTCAGTCCATGCTT (SEQ ID NO: 217) |
| rev_site_8 | TGGAGTTCAGACGTGTGCTCTTCCGATCTTCTGATGGGGAGGAACGAGT (SEQ ID NO: 218) |
| fwd_site_9 | ACACTCTTTCCCTACACGACGCTCTTCCGATCTNNNNCAGCTCAGCCTGAGTGTTGA (SEQ ID NO: 219) |
| rev_site_9 | TGGAGTTCAGACGTGTGCTCTTCCGATCTGCCCACCCTAGTCATTGGAG (SEQ ID NO: 220) |
| fwd_site_10 | ACACTCTTTCCCTACACGACGCTCTTCCGATCTNNNNGTCAGAGGGACACACTGTGG (SEQ ID NO: 221) |
| rev_site_10 | TGGAGTTCAGACGTGTGCTCTTCCGATCTCACACTCACTCACCCACACA (SEQ ID NO: 222) |
| fwd_site_11 | ACACTCTTTCCCTACACGACGCTCTTCCGATCTNNNNTGTGTGGGTGAGTGAGTGTG (SEQ ID NO: 223) |
| rev_site_11 | TGGAGTTCAGACGTGTGCTCTTCCGATCTCACCAAGGTTCACAGCCTGA (SEQ ID NO: 224) |
| fwd_site_12 | ACACTCTTTCCCTACACGACGCTCTTCCGATCTNNNNTTGTCTCTGCCTGTAGCTGC (SEQ ID NO: 225) |
| rev_site_12 | TGGAGTTCAGACGTGTGCTCTTCCGATCTCGCTCTGGGCTTCATCTTCA (SEQ ID NO: 226) |
| fwd_site_13 | ACACTCTTTCCCTACACGACGCTCTTCCGATCTNNNNTGGGATTATGGGTGTGAGCC (SEQ ID NO: 227) |
| rev_site_13 | TGGAGTTCAGACGTGTGCTCTTCCGATCTTGCCTTCCTCCTCTCTCTCC (SEQ ID NO: 228) |
| fwd_site_14 | ACACTCTTTCCCTACACGACGCTCTTCCGATCTNNNNTGCAGACCAGATTCGGAGAA (SEQ ID NO: 229) |
| rev_site_14 | TGGAGTTCAGACGTGTGCTCTTCCGATCTGTTCAGTTTCCAGGGGGTCC (SEQ ID NO: 230) |
| fwd_site_15 | ACACTCTTTCCCTACACGACGCTCTTCCGATCTNNNNTCCGCACAGCCTTAGTTCAA (SEQ ID NO: 231) |
| rev_site_15 | TGGAGTTCAGACGTGTGCTCTTCCGATCTAACTTGAAGAGACGGCAGCA (SEQ ID NO: 232) |
| fwd_site_16 | ACACTCTTTCCCTACACGACGCTCTTCCGATCTNNNNCCCCCAGCTACAGAAAGGTC (SEQ ID NO: 233) |
| rev_site_16 | TGGAGTTCAGACGTGTGCTCTTCCGATCTATTTCCACCGCAAAATGGCC (SEQ ID NO: 234) |
| fwd_site_17 | ACACTCTTTCCCTACACGACGCTCTTCCGATCTNNNNTCACTTCAGCCCAGGAGTAT (SEQ ID NO: 235) |
| rev_site_17 | TGGAGTTCAGACGTGTGCTCTTCCGATCTTGTGTATGGTGAGAGGTAGGGA (SEQ ID NO: 236) |
| fwd_site_18 | ACACTCTTTCCCTACACGACGCTCTTCCGATCTNNNNGTCTGAGGTCACACAGTGGG (SEQ ID NO: 237) |
| rev_site_18 | TGGAGTTCAGACGTGTGCTCTTCCGATCTCTGAGAGCAGGGACCACATC (SEQ ID NO: 238) |
| fwd_site_19 | ACACTCTTTCCCTACACGACGCTCTTCCGATCTNNNNGGGAGGTGGAGAGAGGATGT (SEQ ID NO: 239) |

TABLE 18-continued

HTS Primers used to amplify genomic sites:

| Primer Name | Sequence |
|---|---|
| rev_site_19 | TGGAGTTCAGACGTGTGCTCTTCCGATCTACTCTTCCTGAGGTCTAGGAACCCG (SEQ ID NO: 240) |
| fwd_site_20 | ACACTCTTTCCCTACACGACGCTCTTCCGATCTNNNNCCCTGTTCCTAAAGCCCACC (SEQ ID NO: 241) |
| rev_site_20 | TGGAGTTCAGACGTGTGCTCTTCCGATCTACTCTCTGGTTCTGTTTGTGGCCA (SEQ ID NO: 242) |
| fwd_CTNNB1 | ACACTCTTTCCCTACACGACGCTCTTCCGATCTNNNNATTTGATGGAGTTGGACATGGCC (SEQ ID NO: 243) |
| rev_CTNNB1 | TGGAGTTCAGACGTGTGCTCTCCAGCTACTTGTTCTTGAGTGAAGG (SEQ ID NO: 244) |
| fwd_RSL1D1 | ACACTCTTTCCCTACACGACGCTCTTCCGATCTNNNNTGGCTTTCCAAATCAGTGGGTC (SEQ ID NO: 245) |
| rev_RSL1D1 | TGGAGTTCAGACGTGTGCTCTTCCGATCTCTCATAAGCTTAGACCAACAAGC (SEQ ID NO: 246) |
| fwd_IP90 | ACACTCTTTCCCTACACGACGCTCTTCCGATCTNNNNCTGGTTGACCAATCTGTGGTG (SEQ ID NO: 247) |
| rev_IP90 | TGGAGTTCAGACGTGTGCTCTCTGCGTCTGGATCAGGTACG (SEQ ID NO: 248) |
| fwd_HEK293_site2_off1 | ACACTCTTTCCCTACACGACGCTCTTCCGATCTNNNNGTGTGGAGAGTGAGTAAGCCA (SEQ ID NO: 249) |
| rev_HEK293_site2_off1 | TGGAGTTCAGACGTGTGCTCTTCCGATCTACGGTAGGATGATTTCAGGCA (SEQ ID NO: 250) |
| fwd_HEK293_site2_off2 | ACACTCTTTCCCTACACGACGCTCTTCCGATCTNNNNCACAAAGCAGTGTAGCTCAGG (SEQ ID NO: 251) |
| rev_HEK293_site2_off2 | TGGAGTTCAGACGTGTGCTCTTCCGATCTTTTTTGGTACTCGAGTGTTATTCAG (SEQ ID NO: 252) |
| fwd_HEK293_site3_off1 | ACACTCTTTCCCTACACGACGCTCTTCCGATCTNNNNTCCCCTGTTGACCTGGAGAA (SEQ ID NO: 253) |
| rev_HEK293_site3_off1 | TGGAGTTCAGACGTGTGCTCTTCCGATCTCACTGTACTTGCCCTGACCA (SEQ ID NO: 254) |
| fwd_HEK293_site3_off2 | ACACTCTTTCCCTACACGACGCTCTTCCGATCTNNNNTTGGTGTTGACAGGGAGCAA (SEQ ID NO: 255) |
| rev_HEK293_site3_off2 | TGGAGTTCAGACGTGTGCTCTTCCGATCTCTGAGATGTGGGCAGAAGGG (SEQ ID NO: 256) |
| fwd_HEK293_site3_off3 | ACACTCTTTCCCTACACGACGCTCTTCCGATCTNNNNTGAGAGGGAACAGAAGGGCT (SEQ ID NO: 257) |
| rev_HEK293_site3_off3 | TGGAGTTCAGACGTGTGCTCTTCCGATCTGTCCAAAGGCCCAAGAACCT (SEQ ID NO: 258) |
| fwd_HEK293_site3_off4 | ACACTCTTTCCCTACACGACGCTCTTCCGATCTNNNNTCCTAGCACTTTGGAAGGTCG (SEQ ID NO: 259) |
| rev_HEK293_site3_off4 | TGGAGTTCAGACGTGTGCTCTTCCGATCTGCTCATCTTAATCTGCTCAGCC (SEQ ID NO: 260) |
| fwd_HEK293_site3_off5 | ACACTCTTTCCCTACACGACGCTCTTCCGATCTNNNNAAAGGAGCAGCTCTTCCTGG (SEQ ID NO: 261) |
| rev_HEK293_site3_off5 | TGGAGTTCAGACGTGTGCTCTTCCGATCTGTCTGCACCATCTCCCACAA (SEQ ID NO: 262) |
| fwd_HEK293_site4_off1 | ACACTCTTTCCCTACACGACGCTCTTCCGATCTNNNNGGCATGGCTTCTGAGACTCA (SEQ ID NO: 263) |

TABLE 18-continued

HTS Primers used to amplify genomic sites:

| Primer Name | Sequence |
|---|---|
| rev_HEK293_site4_off1 | TGGAGTTCAGACGTGTGCTCTTCCGATCTGTCTCCCTTGCACTCCCTGTCTTT (SEQ ID NO: 264) |
| fwd_HEK293_site4_off2 | ACACTCTTTCCCTACACGACGCTCTTCCGATCTNNNNTTTGGCAATGGAGGCATTGG (SEQ ID NO: 265) |
| rev_HEK293_site4_off2 | TGGAGTTCAGACGTGTGCTCTTCCGATCTGAAGAGGCTGCCCATGAGAG (SEQ ID NO: 266) |
| fwd_HEK293_site4_off3 | ACACTCTTTCCCTACACGACGCTCTTCCGATCTNNNNGGTCTGAGGCTCGAATCCTG (SEQ ID NO: 267) |
| rev_HEK293_site4_off3 | TGGAGTTCAGACGTGTGCTCTTCCGATCTCTGTGGCCTCCATATCCCTG (SEQ ID NO: 268) |
| fwd_HEK293_site4_off4 | ACACTCTTTCCCTACACGACGCTCTTCCGATCTNNNNTTTCCACCAGAACTCAGCCC (SEQ ID NO: 269) |
| rev_HEK293_site4_off4 | TGGAGTTCAGACGTGTGCTCTTCCGATCTCCTCGGTTCCTCCACAACAC (SEQ ID NO: 270) |
| fwd_HEK293_site4_off5 | ACACTCTTTCCCTACACGACGCTCTTCCGATCTNNNNCACGGGAAGGACAGGAGAAG (SEQ ID NO: 271) |
| rev_HEK293_site4_off5 | TGGAGTTCAGACGTGTGCTCTTCCGATCTGCAGGGGAGGGATAAAGCAG (SEQ ID NO: 272) |
| fwd_HEK_site_3 | ACACTCTTTCCCTACACGACGCTCTTCCGATCTNNNNGGAAACGCCCATGCAATTAGTC (SEQ ID NO: 273) |
| rev_HEK_site_3 | TGGAGTTCAGACGTGTGCTCTTCCGATCTCTTGTCAACCAGTATCCCGGTG (SEQ ID NO: 274) |
| fwd_HEK_site_2 | ACACTCTTTCCCTACACGACGCTCTTCCGATCTNNNNTGAATGGATTCCTTGGAAACAATG (SEQ ID NO: 275) |
| rev_HEK_site_2 | TGGAGTTCAGACGTGTGCTCTTCCGATCTCCAGCCCCATCTGTCAAACT (SEQ ID NO: 276) |
| fwd_HEK_site_4 | TGGAGTTCAGACGTGTGCTCTTCCGATCTTCCTTTCAACCCGAACGGAG (SEQ ID NO: 277) |
| rev_HEK_site_4 | ACACTCTTTCCCTACACGACGCTCTTCCGATCTNNNNGCTGGTCTTCTTTCCCCTCC (SEQ ID NO: 278) |
| fwd_LDLR | ACACTCTTTCCCTACACGACGCTCTTCCGATCTNNNNGCCCTGCTTCTTTTTCTCTGGT (SEQ ID NO: 279) |
| rev_LDLR | TGGAGTTCAGACGTGTGCTCTTCCGATCTACCATTAACGCAGCCAACTTCA (SEQ ID NO: 280) |
| fwd_TRAC | ACACTCTTTCCCTACACGACGCTCTTCCGATCTCATGAGGTCTATGGACTTCAAGAGCAA (SEQ ID NO: 281) |
| Rev_TRAC | TGGAGTTCAGACGTGTGCTCTTCCGATCTCATCATTGACCAGAGCTCTGGGCAGAA (SEQ ID NO: 282) |
| fwd_CBLB | ACACTCTTTCCCTACACGACGCTCTTCCGATCTGCACTTACCAGCATTACTTCCTAAACC (SEQ ID NO: 283) |
| Rev_CBLB | TGGAGTTCAGACGTGTGCTCTTCCGATCTATGGGCTCCACTTTTCAGCTCTGTAA (SEQ ID NO: 284) |
| fwd_CD7 | ACACTCTTTCCCTACACGACGCTCTTCCGATCTCAGTTCAGGCACATGTAGGAGGGA (SEQ ID NO: 285) |
| Rev_CD7 | TGGAGTTCAGACGTGTGCTCTTCCGATCTACCGCCTGCAGCTGTCGGACACTGGCA (SEQ ID NO: 286) |
| fwd_B2M | ACACTCTTTCCCTACACGACGCTCTTCCGATCTAAAAGATGAGTATGCCTGCCGTG (SEQ ID NO: 287) |
| Rev_B2M | TGGAGTTCAGACGTGTGCTCTTCCGATCTCAGATTGTTTATATCAGATGGGATGGG (SEQ ID NO: 288) |

TABLE 18-continued

HTS Primers used to amplify genomic sites:

| Primer Name | Sequence |
| --- | --- |
| fwd_CIITA | ACACTCTTTCCCTACACGACGCTCTTCCGATCTATGCAAGTTTGGTCCTGAG CCCTCCC (SEQ ID NO: 289) |
| Rev_CITTA | TGGAGTTCAGACGTGTGCTCTTCCGATCTGATGTGGGTTCCCTGCGCTCTGC A (SEQ ID NO: 290) |
| fwd_PDCD1 | ACACTCTTTCCCTACACGACGCTCTTCCGATCTCCAGGGACTGAGGGTGGAA GGTCC (SEQ ID NO: 291) |
| Rev_PDCD1 | TGGAGTTCAGACGTGTGCTCTTCCGATCTACCTCCGCCTGAGCAGTGGAGAA (SEQ ID NO: 292) | mRNA Production for ABE Editors Used in CD34+ Cells

All adenine base editor mRNA was generated using the following synthesis protocol. Editors were cloned into a plasmid encoding a dT7 promoter followed by a 5'UTR, Kozak sequence, ORF, and 3'UTR. The dT7 promoter carries an inactivating point mutation within the T7 promoter that prevents transcription from circular plasmid. This plasmid templated a PCR reaction (Q5 Hot Start 2× Master Mix), in which the forward primer corrected the SNP within the T7 promoter and the reverse primer appended a polyA tail to the 3' UTR. The resulting PCR product was purified on a Zymo Research 25 µg DCC column and used as mRNA template in the subsequent in vitro transcription. The NEB HiScribe High-Yield Kit was used according to the instruction manual, but with full substitution of N1-methyl-pseudouridine for uridine and co-transcriptional capping with CleanCap AG (Trilink). Reaction cleanup was performed by lithium chloride precipitation. Primers used for amplification can be found in Table 18.

The Cas9 mRNA used here was purchased from Trilink (CleanCap Cas9 mRNA 5moU) and the CBE mRNA used in the whole genome sequencing experiment was generated in-house.

and raised to a total of 54 in MaxCyte buffer. 20l of cells was the added into the 5 µL RNA mixture in groups of 3 and loaded into each chamber of an OC25x3 MaxCyte cuvette for electroporation. After receiving the charge, 25l was collected from the chambers and placed in the center of the wells in a 24-well untreated tissue culture plate. The cells recovered for 20 minutes in an incubator (37° C., 5% $CO_2$). After the 20 minute recovery, X-VIVO 10 medium containing 1% Glutamax, 100 ng/mL of TPO, SCF and Flt-3 was added to the cells for a concentration of 1,000,000 cells per mL. The cells were then left to further recover in an incubator (37° C., 5% $CO_2$) for 48 hrs.

Erythrocyte Differentiation Post ABE Electroporation

Following 48 h post electroporation rest (day 0 of culture), the cells were centrifuged and moved to "Phase 1" IMDM media (ATCC) containing 5% human serum, 330 µg/mL transferrin (Sigma), 10 µg/mL human insulin (Sigma), 2U/mL heparin sodium (Sigma), 3U/mL EPO (Peprotech), 100 ng/mL SCF (Peprotech), 5 µg/mL IL3 and 50 µM hydrocortisone (Sigma) at 20,000 cells per mL. On day 4 of culture, the cells were fed 4x volume of the same media. On day 7, the cells were spun down and moved to "Phase 2" IMDM media containing 5% human serum

TABLE 19

Primers used for ABE8 T7 in vitro transcription reactions

| Name | Sequence |
| --- | --- |
| fwd_IVT | TCGAGCTCGGTACCTAATACGACTCAC (SEQ ID NO: 293) |
| rev_IVT | TTTTTTTTTTTTTTTTTTTTTTTTTTTTTTTTTTTTTTTTTTTTTTTTTTTTTT TTTTTTTTTTTTTTTTTTTTTTTTTTTTTTTTTTTTTTTTTTTTTTTTTTTTT CTTCCTACTCAGGCTTTATTCAAAGACCA (SEQ ID NO: 294) |

CD34+ Cell Preparation

Mobilized peripheral blood was obtained and enriched for Human CD34+ HSPCs and frozen in single-use aliquots (HemaCare, M001F-GCSF/MOZ-2). The CD34+ cells were thawed and put into X-VIVO 10 (Lonza) containing 1% Glutamax (Gibco), 100 ng/mL of TPO (Peprotech), SCF (Peprotech) and Flt-3 (Peprotech) and cultured for 48 hours prior to electroporation.

Electroporation of CD34+ Cells 48 hours post thaw, the cells were centrifuged to remove the X-VIVO 10 medium and washed in MaxCyte buffer (HyClone) with 0.1% HSA (Akron Biotechnologies). The cells were then resuspended in cold MaxCyte buffer at 1,250,000 cells per mL and split into multiple 20l aliquots. The ABE mRNA (0.15 µM) and −198 HBG1/2 sgRNA (4.05 µM) were then aliquoted as per the experimental conditions (Sigma), 330 µg/mL transferrin, 10 µg/mL human insulin, 2U/mL heparin sodium, 3U/mL EPO and 100 ng/mL SCF at 200,000 cells per mL. On day 11, cells were centrifuged and moved to "Phase 3" IMDM media containing 5% human serum, 330 µg/mL of transferrin, 10µg/mL human insulin, 2U/mL of heparin sodium and 3 U/mL of EPO at 1,000,000 cells per mL. On day 14, the cells were centrifuged and resuspended in the same media as used on day 11, but at 5,000,000 cells per mL. On day 18, the differentiated red blood cells were collected in 500,000 cell aliquots, washed once in 500 µL DPBS (Gibco) and frozen at −80° C. for 24 hours before UHPLC processing.

Preparation of Red Blood Cell Sample for UHPLC Analysis

Frozen red blood cell pellets were thawed at room temperature. Pellets were diluted to a final concentration of $5 \times 10^4$ cells/4 with ACK lysis buffer. Samples were mixed by pipette and incubated at room temperate for 5 min. Samples were then frozen in at −80° C. for 5 min, allowed to thaw, and mixed by pipette prior to centrifugation at 6,700g for 10 min. The supernatant was carefully removed (without disturbing cell debris pellet), transferred to a new plate in which a 10-fold dilution in ultrapure water was done for UHPLC analysis.

Ultra-High Performance Liquid Chromatography (UHPLC) Analysis

Reverse-phase separation of globin chains was performed using a UHPLC system configured with a binary pump and UV detector (Thermo Fisher Scientific, Vanquish Horizon). The Waters AQUITY Peptide BEH C18 VanGuard pre-column (2.1×5 mm, 1.7 μm beads, 300 Å pore size) followed by ACQUITY Peptide BEH C18 Column (2.1×150 mm, 1.7 μm beads, 300 Å pore size) (Waters Corp) were used for the separation with a column temperature of 60° C. Elution was performed using 0.1% trifluoroacetic acid (TFA) in water (A) and 0.08% TFA in acetonitrile (B) with a flow rate of 0.25 mL/min. Separation of the globin chains was achieved using a linear gradient of 40-52% B 0-10 min; 52-40% B 10-10.5 min; and 40% B to 12 min. Sample injection volume was 104. UV spectra at a wavelength of 220 nm with a data rate of 5 Hz was collected throughout the analysis. Globin chain identities were confirmed through LC/MS analysis of hemoglobin standards.

Genomic DNA Extraction for CD34+ Cells

Following ABE electroporation (e.g., 48h later), an aliquot of cells was cultured in X-VIVO 10 media (Lonza) containing 1% Glutamax (Gibco), 100 ng/mL of TPO (Peprotech), SCF (Peprotech) and Flt-3 (Peprotech). Following 48 h and 144 h post culturing, 100,000 cells were collected and centrifuged. 50 μL of Quick Extract (Lucigen) was added to the cell pellet and the cell mixture was transferred to a 96-well PCR plate (Bio-Rad). The lysate was heated for 15 minutes at 65° C., followed by 10 minutes at 98° C. The cell lysates were stored at −20° C.

OTHER EMBODIMENTS

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

All publications, patents, and patent applications mentioned in this specification are herein incorporated by reference to the same extent as if each individual publication, patent, or patent application was specifically and individually indicated to be incorporated by reference. Absent any indication otherwise, publications, patents, and patent applications mentioned in this specification are incorporated herein by reference in their entireties.

SEQUENCE LISTING (310 sequences)

SEQ ID NO: 1 - protein, 1368 aa, Streptococcus pyogenes [sequence omitted]

SEQ ID NO: 2 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 3 - protein, 1410 aa, Artificial Sequence
  Description of Artificial Sequence: Synthetic polypeptide
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 4 - RNA, 20 nt, Artificial Sequence
  Description of Artificial Sequence: Synthetic oligonucleotide
cuucuccacaggagucagau

SEQ ID NO: 5 - RNA, 21 nt, Artificial Sequence
  Description of Artificial Sequence: Synthetic oligonucleotide
acuucuccacaggagucagau

SEQ ID NO: 6 - RNA, 22 nt, Artificial Sequence
  Description of Artificial Sequence: Synthetic oligonucleotide
gacuucuccacaggagucagau

SEQ ID NO: 7 - RNA, 125 nt, Artificial Sequence
  Description of Artificial Sequence: Synthetic polynucleotide
guuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 8 - RNA, 145 nt, Artificial Sequence
  Description of Artificial Sequence: Synthetic polynucleotide
cuucuccacaggagucagauguuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 9 - RNA, 146 nt, Artificial Sequence
  Description of Artificial Sequence: Synthetic polynucleotide
acuucuccacaggagucagauguuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 10 - RNA, 147 nt, Artificial Sequence
  Description of Artificial Sequence: Synthetic polynucleotide
gacuucuccacaggagucagauguuuuuguacucucaagauuuaaguaacuguacaacgaaacuuacacaguuacuuaaaucuugcagaagcuacaaagauaaggcuucaugccgaaaucaacacccugucauuuuauggcagggug

SEQ ID NO: 11 - protein, 7 aa, Artificial Sequence
  Description of Artificial Sequence: Synthetic peptide
RNEHLEV

SEQ ID NO: 12 - protein, 7 aa, Artificial Sequence
  Description of Artificial Sequence: Synthetic peptide
QSTTLKR

SEQ ID NO: 13 - protein, 7 aa, Artificial Sequence
  Description of Artificial Sequence: Synthetic peptide
RTEHLAR

SEQ ID NO: 14 - protein, 7 aa, Artificial Sequence
  Description of Artificial Sequence: Synthetic peptide
RGEHLRQ

SEQ ID NO: 15 - protein, 7 aa, Artificial Sequence
  Description of Artificial Sequence: Synthetic peptide
QSGTLKR

SEQ ID NO: 16 - protein, 7 aa, Artificial Sequence
  Description of Artificial Sequence: Synthetic peptide
RNDKLVP

SEQ ID NO: 17 - protein, 167 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTD

SEQ ID NO: 18 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 19 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 20 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 21 - protein, 164 aa, Shewanella putrefaciens
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 22 - protein, 173 aa, Haemophilus influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 23 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 24 - protein, 179 aa, Geobacter sulfurreducens
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 25 - DNA, 8811 bp, Artificial Sequence
  Description of Artificial Sequence: Synthetic polynucleotide
atatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagagatccgcggccgctaatacgactcactatagggagagccgccaccatgaaacggacagccgacggaagcgagttcgagtcaccaaagaagaagcggaaagtctctgaagtcgagtttagccacgagtattggatgaggcacgcactgaccctggcaaagcgagcatgggatgaaagagaagtccccgtgggcgccgtgctggtgcacaacaatagagtgatcggagagggatggaacaggccaatcggccgccacgaccctaccgcacacgcagagatcatggcactgaggcagggaggcctggtcatgcagaattaccgcctgatcgatgccaccctgtatgtgacactggagccatgcgtgatgtgcgcaggagcaatgatccacagcaggatcggaagagtggtgttcggagcacgggacgccaagaccggcgcagcaggctccctgatggatgtgctgcaccaccccggcatgaaccaccgggtggagatcacagagggaatcctggcagacgagtgcgccgccctgctgagcgatttctttagaatgcggagacaggagatcaaggcccagaagaaggcacagagctccaccgactctggaggatctagcggaggatcctctggaagcgagacaccaggcacaagcgagtccgccacaccagagagctccggcggctcctccggaggatcctctgaggtggagttttcccacgagtactggatgagacatgccctgaccctggccaagagggcacgcgatgagagggaggtgcctgtgggagccgtgctggtgctgaacaatagagtgatcggcgagggctggaacagagccatcggcctgcacgacccaacagcccatgccgaaattatggccctgagacagggcggcctggtcatgcagaactacagactgattgacgccaccctgtacgtgacattcgagccttgcgtgatgtgcgccggcgccatgatccactctaggatcggccgcgtggtgtttggcgtgaggaacgcaaaaaccggcgccgcaggctccctgatggacgtgctgcactaccccggcatgaatcaccgcgtcgaaattaccgagggaatcctggcagatgaatgtgccgccctgctgtgctatttctttcggatgcctagacaggtgttcaatgctcagaagaaggcccagagctccaccgactccggaggatctagcggaggctcctctggctctgagacacctggcacaagcgagagcgcaacacctgaaagcagcgggggcagcagcggggggtcagacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggaaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggaccatatcgtgcctcagagctttctgaaggacgactccatcgacaacaaggtgctgaccagaagcgacaagaaccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggtgactctggcggctcaaaaagaaccgccgacggcagcgaattcgagcccaagaagaagaggaaagtctaaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctcgataccgtcgacctctagctagagcttggcgtaatcatggtcatagctgtttcctgtgtgaaattgttatccgctcacaattccacacaacatacgagccggaagcataaagtgtaaagcctagggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacactcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtcgacggatcgggagatcgatctcccgatcccctagggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatc

SEQ ID NO: 26 - protein, 147 aa, Homo sapiens
MVHLTPEEKSAVTALWGKVNVDEVGGEALGRLLVVYPWTQRFFESFGDLSTPDAVMGNPKVKAHGKKVLGAFSDGLAHLDNLKGTFATLSELHCDKLHVDPENFRLLGNVLVCVLAHHFGKEFTPPVQAAYQKVVAGVANALAHKYH

SEQ ID NO: 27 - DNA, 628 bp, Homo sapiens
acatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcaggctcctgggcaacgtgctggtctgtgtgctggcccatcactttggcaaagaattcaccccaccagtgcaggctgcctatcagaaagtggtggctggtgtggctaatgccctggcccacaagtatcactaagctcgctttcttgctgtccaatttctattaaaggttcctttgttccctaagtccaactactaaactgggggatattatgaagggccttgagcatctggattctgcctaataaaaaacatttattttcattgcaa

SEQ ID NO: 28 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 29 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 30 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 31 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 33 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 34 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 35 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 38 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 40 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 41 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 42 - protein, 986 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 43 - protein, 1210 aa, Unknown
  Description of Unknown: uncultured Parcubacteria group bacterium sequence
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 44 - DNA, 306 bp, Artificial Sequence
  Description of Artificial Sequence: Synthetic polynucleotide
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 45 - protein, 102 aa, Artificial Sequence
  Description of Artificial Sequence: Synthetic polypeptide
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 46 - DNA, 108 bp, Artificial Sequence
  Description of Artificial Sequence: Synthetic polynucleotide
atgatcaagatagctacaaggaagtatcttggcaaacaaaacgtttatgatattggagtcgaaagagatcacaactttgctctgaagaacggattcatagcttctaat

SEQ ID NO: 47 - protein, 36 aa, Artificial Sequence
  Description of Artificial Sequence: Synthetic polypeptide
MIKIATRKYLGKQNVYDIGVERDHNFALKNGFIASN

SEQ ID NO: 48 - DNA, 303 bp, Artificial Sequence
  Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 49 - protein, 101 aa, Artificial Sequence
  Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 50 - DNA, 159 bp, Artificial Sequence
  Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 51 - protein, 53 aa, Artificial Sequence
  Description of Artificial Sequence: Synthetic polypeptide
MKRTADGSEFESPKKKRKVKIISRKSLGTQNVYDIGVEKDHNFLLKNGLVASN

SEQ ID NO: 52 - protein, 24 aa, Artificial Sequence
  Description of Artificial Sequence: Synthetic peptide
SGGSSGSETPGTSESATPESSGGS

SEQ ID NO: 53 - protein, 32 aa, Artificial Sequence
  Description of Artificial Sequence: Synthetic polypeptide
SGGSSGGSSGSETPGTSESATPESSGGSSGGS

SEQ ID NO: 54 - protein, 104 aa, Artificial Sequence
  Description of Artificial Sequence: Synthetic polypeptide
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 55 - protein, 16 aa, Artificial Sequence
  Description of Artificial Sequence: Synthetic peptide
SGSETPGTSESATPES

SEQ ID NO: 56 - protein, 4 aa, Artificial Sequence
  Description of Artificial Sequence: Synthetic peptide
SGGS

SEQ ID NO: 57 - protein, 120 aa, Artificial Sequence
  Description of Artificial Sequence: Synthetic polypeptide
  MISC_FEATURE (1)..(120): This sequence may encompass 1-30 "Ser Gly Gly Ser" repeating units
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 58 - protein, 120 aa, Artificial Sequence
  Description of Artificial Sequence: Synthetic polypeptide
  MISC_FEATURE (1)..(120): This sequence may encompass 1-30 "Gly Gly Gly Ser" repeating units
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 59 - protein, 150 aa, Artificial Sequence
  Description of Artificial Sequence: Synthetic polypeptide
  MISC_FEATURE (1)..(150): This sequence may encompass 1-30 "Gly Gly Gly Gly Ser" repeating units
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 60 - protein, 30 aa, Artificial Sequence
  Description of Artificial Sequence: Synthetic polypeptide
  MISC_FEATURE (1)..(30): This sequence may encompass 1-30 residues
GGGGGGGGGGGGGGGGGGGGGGGGGGGGGG

SEQ ID NO: 61 - protein, 150 aa, Artificial Sequence
  Description of Artificial Sequence: Synthetic polypeptide
  MISC_FEATURE (1)..(150): This sequence may encompass 1-30 "Glu Ala Ala Ala Lys" repeating units
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 62 - protein, 90 aa, Artificial Sequence
  Description of Artificial Sequence: Synthetic polypeptide
  MISC_FEATURE (1)..(90): This sequence may encompass 1-30 "Gly Gly Ser" repeating units
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 63 - protein, 60 aa, Artificial Sequence
  Description of Artificial Sequence: Synthetic polypeptide
  MOD_RES (1)..(1): Any amino acid
  MOD_RES (3)..(3): Any amino acid
  MOD_RES (5)..(5): Any amino acid
  MOD_RES (7)..(7): Any amino acid
  MOD_RES (9)..(9): Any amino acid
  MOD_RES (11)..(11): Any amino acid
  MOD_RES (13)..(13): Any amino acid
  MOD_RES (15)..(15): Any amino acid
  MOD_RES (17)..(17): Any amino acid
  MOD_RES (19)..(19): Any amino acid
  MOD_RES (21)..(21): Any amino acid
  MOD_RES (23)..(23): Any amino acid
  MOD_RES (25)..(25): Any amino acid
  MOD_RES (27)..(27): Any amino acid
  MOD_RES (29)..(29): Any amino acid
  MOD_RES (31)..(31): Any amino acid
  MOD_RES (33)..(33): Any amino acid
  MOD_RES (35)..(35): Any amino acid
  MOD_RES (37)..(37): Any amino acid
  MOD_RES (39)..(39): Any amino acid
  MOD_RES (41)..(41): Any amino acid
  MOD_RES (43)..(43): Any amino acid
  MOD_RES (45)..(45): Any amino acid
  MOD_RES (47)..(47): Any amino acid
  MOD_RES (49)..(49): Any amino acid
  MOD_RES (51)..(51): Any amino acid
  MOD_RES (53)..(53): Any amino acid
  MOD_RES (55)..(55): Any amino acid
  MOD_RES (57)..(57): Any amino acid
  MOD_RES (59)..(59): Any amino acid
  MISC_FEATURE (1)..(60): This sequence may encompass 1-30 "Xaa Pro" repeating units
XPXPXPXPXPXPXPXPXPXPXPXPXPXPXPXPXPXPXPXPXPXPXPXPXPXPXPXPXPXP

SEQ ID NO: 64 - protein, 24 aa, Artificial Sequence
  Description of Artificial Sequence: Synthetic peptide
SGGSSGGSSGSETPGTSESATPES

SEQ ID NO: 65 - protein, 40 aa, Artificial Sequence
  Description of Artificial Sequence: Synthetic polypeptide
SGGSSGGSSGSETPGTSESATPESSGGSSGGSSGGSSGGS

SEQ ID NO: 66 - protein, 64 aa, Artificial Sequence
  Description of Artificial Sequence: Synthetic polypeptide
SGGSSGGSSGSETPGTSESATPESSGGSSGGSSGGSSGGSSGSETPGTSESATPESSGGSSGGS

SEQ ID NO: 67 - protein, 92 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 68 - protein, 18 aa, Artificial Sequence
  Description of Artificial Sequence: Synthetic peptide
KRTADGSEFESPKKKRKV

SEQ ID NO: 69 - protein, 16 aa, Artificial Sequence
  Description of Artificial Sequence: Synthetic peptide
KRPAATKKAGQAKKKK

SEQ ID NO: 70 - protein, 17 aa, Artificial Sequence
  Description of Artificial Sequence: Synthetic peptide
KKTELQTTNAENKTKKL

SEQ ID NO: 71 - protein, 19 aa, Artificial Sequence
  Description of Artificial Sequence: Synthetic peptide
KRGINDRNFWRGENGRKTR

SEQ ID NO: 72 - protein, 16 aa, Artificial Sequence
  Description of Artificial Sequence: Synthetic peptide
RKSGKIAAIVVKRPRK

SEQ ID NO: 73 - protein, 7 aa, Artificial Sequence
  Description of Artificial Sequence: Synthetic peptide
PKKKRKV

SEQ ID NO: 74 - protein, 30 aa, Artificial Sequence
  Description of Artificial Sequence: Synthetic polypeptide
MDSLLMNRRKFLYQFKNVRWAKGRRETYLC

SEQ ID NO: 75 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 76 - DNA, 23 bp, Homo sapiens
gtggggaaggggcccccaagagg

SEQ ID NO: 77 - protein, 1807 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 78 - RNA, 80 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugcuuuu

SEQ ID NO: 79 - protein, 987 aa, Unknown
  Description of Unknown: Deltaproteobacteria CasX sequence
MEKRINKIRKKLSADNATKPVSRSGPMKTLLVRVMTDDLKKRLEKRRKKPEVMPQVISNNAANNLRMLLDDYTKMKEAILQVYWQEFKDDHVGLMCKFAQPASKKIDQNKLKPEMDEKGNLTTAGFACSQCGQPLFVYKLEQVSEKGKAYTNYFGRCNVAEHEKLILLAQLKPVKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDFAYNEVIARVRMWVNLNLWQKLKLSRDDAKPLLRLKGFPSFPVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAENRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVDPSNIKPVNLIGVARGENIPAVIALTDPEGCPLPEFKDSSGGPTDILRIGEGYKEKQRAIQAAKEVEQRRAGGYSRKFASKSRNLADDMVRNSARDLFYHAVTHDAVLVFANLSRGFGRQGKRTFMTERQYTKMEDWLTAKLAYEGLTSKTYLSKTLAQYTSKTCSNCGFTITYADMDVMLVRLKKTSDGWATTLNNKELKAEYQITYYNRYKRQTVEKELSAELDRLSEESGNNDISKWTKGRRDEALFLLKKRFSHRPVQEQFVCLDCGHEVHAAEQAALNIARSWLFLNSNSTEFKSYKSGKQPFVGAWQAFYKRRLKEVWKPNA

SEQ ID NO: 80 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 81 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 82 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 83 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 84 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 85 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 86 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 87 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 88 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 89 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 90 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 91 - protein, 1140 aa, Bacillus hisashii
MAPKKKRKVGIHGVPAAATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSMKRPAATKKAGQAKKKK

SEQ ID NO: 92 - protein, 1112 aa, Bacillus sp.
MAIRSIKLKMKTNSGTDSIYLRKALWRTHQLINEGIAYYMNLLTLYRQEAIGDKTKEAYQAELINIIRNQQRNNGSSEEHGSDQEILALLRQLYELIIPSSIGESGDANQLGNKFLYPLVDPNSQSGKGTSNAGRKPRWKRLKEEGNPDWELEKKKDEERKAKDPTVKIFDNLNKYGLLPLFPLFTNIQKDIEWLPLGKRQSVRKWDKDMFIQAIERLLSWESWNRRVADEYKQLKEKTESYYKEHLTGGEEWIEKIRKFEKERNMELEKNAFAPNDGYFITSRQIRGWDRVYEKWSKLPESASPEELWKVVAEQQNKMSEGFGDPKVFSFLANRENRDIWRGHSERIYHIAAYNGLQKKLSRTKEQATFTLPDAIEHPLWIRYESPGGTNLNLFKLEEKQKKNYYVTLSKIIWPSEEKWIEKENIEIPLAPSIQFNRQIKLKQHVKGKQEISFSDYSSRISLDGVLGGSRIQFNRKYIKNHKELLGEGDIGPVFFNLVVDVAPLQETRNGRLQSPIGKALKVISSDFSKVIDYKPKELMDWMNTGSASNSFGVASLLEGMRVMSIDMGQRTSASVSIFEVVKELPKDQEQKLFYSINDTELFAIHKRSFLLNLPGEVVTKNNKQQRQERRKKRQFVRSQIRMLANVLRLETKKTPDERKKAIHKLMEIVQSYDSWTASQKEVWEKELNLLTNMAAFNDEIWKESLVELHHRIEPYVGQIVSKWRKGLSEGRKNLAGISMWNIDELEDTRRLLISWSKRSRTPGEANRIETDEPFGSSLLQHIQNVKDDRLKQMANLIIMTALGFKYDKEEKDRYKRWKETYPACQIILFENLNRYLFNLDRSRRENSRLMKWAHRSIPRTVSMQGEMFGLQVGDVRSEYSSRFHAKTGAPGIRCHALTEEDLKAGSNTLKRLIEDGFINESELAYLKKGDIIPSQGGELFVTLSKRYKKDSDNNELTVIHADINAAQNLQKRFWQQNSEVYRVPCQLARMGEDKLYIPKSQTETIKKYFGKGSFVKNNTEQEVYKWEKSEKMKIKTDTTFDLQDLDGFEDISKTIELAQEQQKKYLTMFRDPSGYFFNNETWRPQKEYWSIVNNIIKSCLKKKILSNKVEL

SEQ ID NO: 93 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESVLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 94 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 95 - protein, 1368 aa, Artificial Sequence
  Description of Artificial Sequence: Synthetic polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 96 - protein, 1359 aa, Artificial Sequence
  Description of Artificial Sequence: Synthetic polypeptide
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 97 - protein, 1367 aa, Artificial Sequence
  Description of Artificial Sequence: Synthetic polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 98 - protein, 29 aa, Artificial Sequence
  Description of Artificial Sequence: Synthetic peptide
PKKKRKVEGADKRTADGSEFESPKKKRKV

SEQ ID NO: 99 - protein, 23 aa, Artificial Sequence
  Description of Artificial Sequence: Synthetic peptide
RKSGKIAAIVVKRPRKPKKKRKV

SEQ ID NO: 100 - protein, 16 aa, Artificial Sequence
  Description of Artificial Sequence: Synthetic peptide
KRPAATKKAGQAKKKK

SEQ ID NO: 101 - protein, 167 aa, Escherichia coli
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 102 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 103 - protein, 167 aa, Escherichia coli; identical to SEQ ID NO: 2

SEQ ID NO: 104 - protein, 8 aa, Artificial Sequence
  Description of Artificial Sequence: Synthetic peptide
SGGSSGGS

SEQ ID NO: 105 - protein, 1609 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 106 - protein, 1807 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDGGSSGGSSGSETPGTSESATPESSGGSSGGSMSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFMQPTVAYSVLVVAKVEKGKSKKLKSVKELLGITIMERSSFEKNPIDFLEAKGYKEVKKDLIIKLPKYSLFELENGRKRMLASAKFLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPRAFKYFDTTIARKEYRSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEGADKRTADGSEFESPKKKRKV

SEQ ID NO: 107 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 108 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 109 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 110 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 111 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 112 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 113 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 114 - protein, 1786 aa, Artificial Sequence
  Description of Artificial Sequence: Synthetic polypeptide
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDEGADKRTADGSEFESPKKKRKV

SEQ ID NO: 115 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 116 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 117 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 118 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 119 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 120 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 121 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 122 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 123 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHYPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 124 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCRFFRMPRRVFNAQKKAQSSRDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 125 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 126 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCTFFRMPRSVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 127 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLYDATLYVTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 128 - protein, 1588 aa, Artificial Sequence
  Description of Artificial Sequence: Synthetic polypeptide
MSEVEFSHEYWMRHALTLAKRARDEREVPVGAVLVLNNRVIGEGWNRAIGLHDPTAHAEIMALRQGGLVMQNYRLIDATLYSTFEPCVMCAGAMIHSRIGRVVFGVRNAKTGAAGSLMDVLHYPGMNHRVEITEGILADECAALLCYFFRMPRRVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGDEGADKRTADGSEFESPKKKRKV

SEQ ID NO: 129 - protein, 4 aa, Artificial Sequence
  Description of Artificial Sequence: Synthetic peptide
SGGS

SEQ ID NO: 130 - protein, 4 aa, Artificial Sequence
  Description of Artificial Sequence: Synthetic peptide
GGGS

SEQ ID NO: 131 - protein, 5 aa, Artificial Sequence
  Description of Artificial Sequence: Synthetic peptide
GGGGS

SEQ ID NO: 132 - protein, 5 aa, Artificial Sequence
  Description of Artificial Sequence: Synthetic peptide
EAAAK

SEQ ID NO: 133 - protein, 21 aa, Artificial Sequence
  Description of Artificial Sequence: Synthetic peptide
  MISC_FEATURE (1)..(21): This sequence may encompass 1, 3 or 7 "Gly Gly Ser" repeating units
GGSGGSGGSGGSGGSGGSGGS

SEQ ID NO: 134 - protein, 5 aa, Artificial Sequence
  Description of Artificial Sequence: Synthetic peptide
PAPAP

SEQ ID NO: 135 - protein, 6 aa, Artificial Sequence
  Description of Artificial Sequence: Synthetic peptide
PAPAPA

SEQ ID NO: 136 - protein, 7 aa, Artificial Sequence
  Description of Artificial Sequence: Synthetic peptide
PAPAPAP

SEQ ID NO: 137 - protein, 8 aa, Artificial Sequence
  Description of Artificial Sequence: Synthetic peptide
PAPAPAPA

SEQ ID NO: 138 - protein, 9 aa, Artificial Sequence
  Description of Artificial Sequence: Synthetic peptide
PAPAPAPAP

SEQ ID NO: 139 - protein, 15 aa, Artificial Sequence
  Description of Artificial Sequence: Synthetic peptide
PAPAPAPAPAPAPAP

SEQ ID NO: 140 - protein, 21 aa, Artificial Sequence
  Description of Artificial Sequence: Synthetic peptide
PAPAPAPAPAPAPAPAPAPAP

SEQ ID NO: 141 - DNA, 117 bp, Artificial Sequence
  Description of Artificial Sequence: Synthetic polynucleotide
  modified_base (98)..(117): a, c, t, g, unknown or other
gttctgtcttttggtcaggacaaccgtctagctataagtgctgcagggtgtgagaaactcctattgctggacgatgtctcttacgaggcattagcacnnnnnnnnnnnnnnnnnnnn

SEQ ID NO: 142 - DNA, 108 bp, Artificial Sequence
  Description of Artificial Sequence: Synthetic polynucleotide
  modified_base (89)..(108): a, c, t, g, unknown or other
gacctatagggtcaatgaatctgtgcgtgtgccataagtaattaaaaattacccaccacaggagcacctgaaaacaggtgcttggcacnnnnnnnnnnnnnnnnnnnn

SEQ ID NO: 143 - DNA, 119 bp, Artificial Sequence
  Description of Artificial Sequence: Synthetic polynucleotide
  modified_base (100)..(119): a, c, t, g, unknown or other
gtctaaaggacagaatttttcaacgggtgtgccaatggccactttccaggtggcaaagcccgttgaacttctcaaaaagaacgatctgagaagtggcacnnnnnnnnnnnnnnnnnnnn

SEQ ID NO: 144 - RNA, 20 nt, Artificial Sequence
  Description of Artificial Sequence: Synthetic oligonucleotide
guggggaaggggcccccaag

SEQ ID NO: 145 - RNA, 20 nt, Artificial Sequence
  Description of Artificial Sequence: Synthetic oligonucleotide
auugagauaguguggggaag

SEQ ID NO: 146 - RNA, 20 nt, Artificial Sequence
  Description of Artificial Sequence: Synthetic oligonucleotide
cauugagauaguguggggaa

SEQ ID NO: 147 - RNA, 20 nt, Artificial Sequence
  Description of Artificial Sequence: Synthetic oligonucleotide
gcauugagauagugugggga

SEQ ID NO: 148 - RNA, 20 nt, Artificial Sequence
  Description of Artificial Sequence: Synthetic oligonucleotide
gcuauuggucaaggcaaggc

SEQ ID NO: 149 - RNA, 20 nt, Artificial Sequence
  Description of Artificial Sequence: Synthetic oligonucleotide
caaggcuauuggucaaggca

SEQ ID NO: 150 - RNA, 20 nt, Artificial Sequence
  Description of Artificial Sequence: Synthetic oligonucleotide
cuugucaaggcuauugguca

SEQ ID NO: 151 - RNA, 20 nt, Artificial Sequence
  Description of Artificial Sequence: Synthetic oligonucleotide
cuugaccaauagccuugaca

SEQ ID NO: 152 - RNA, 20 nt, Artificial Sequence
  Description of Artificial Sequence: Synthetic oligonucleotide
guuugccuugucaaggcuau

SEQ ID NO: 153 - RNA, 20 nt, Artificial Sequence
  Description of Artificial Sequence: Synthetic oligonucleotide
uggucaaguuugccuuguca

SEQ ID NO: 154 - RNA, 20 nt, Artificial Sequence
  Description of Artificial Sequence: Synthetic oligonucleotide
uggggaaggggcccccaaga

SEQ ID NO: 155 - RNA, 20 nt, Artificial Sequence
  Description of Artificial Sequence: Synthetic oligonucleotide
guguggggaaggggccccca

SEQ ID NO: 156 - RNA, 20 nt, Artificial Sequence
  Description of Artificial Sequence: Synthetic oligonucleotide
ucagacagauauuugcauug

SEQ ID NO: 157 - RNA, 20 nt, Artificial Sequence
  Description of Artificial Sequence: Synthetic oligonucleotide
uuucagacagauauuugcau

SEQ ID NO: 158 - RNA, 20 nt, Artificial Sequence
  Description of Artificial Sequence: Synthetic oligonucleotide
cuugccuugaccaauagccu

SEQ ID NO: 159 - RNA, 20 nt, Artificial Sequence
  Description of Artificial Sequence: Synthetic oligonucleotide
uagccuugacaaggcaaacu

SEQ ID NO: 160 - RNA, 20 nt, Artificial Sequence
  Description of Artificial Sequence: Synthetic oligonucleotide
caaacuugaccaauagucuu

SEQ ID NO: 161 - RNA, 20 nt, Artificial Sequence
  Description of Artificial Sequence: Synthetic oligonucleotide
uguggggaaggggcccccaa

SEQ ID NO: 162 - RNA, 20 nt, Artificial Sequence
  Description of Artificial Sequence: Synthetic oligonucleotide
gggccccuuccccacacuau

SEQ ID NO: 163 - RNA, 20 nt, Artificial Sequence
  Description of Artificial Sequence: Synthetic oligonucleotide
cagacagauauuugcauuga

SEQ ID NO: 164 - RNA, 20 nt, Artificial Sequence
  Description of Artificial Sequence: Synthetic oligonucleotide
gccuugacaaggcaaacuug

SEQ ID NO: 165 - RNA, 20 nt, Artificial Sequence
  Description of Artificial Sequence: Synthetic oligonucleotide
uugacaaggcaaacuugacc

SEQ ID NO: 166 - RNA, 20 nt, Artificial Sequence
  Description of Artificial Sequence: Synthetic oligonucleotide
ugaccaauagucuuagagua

SEQ ID NO: 167 - RNA, 23 nt, Artificial Sequence
  Description of Artificial Sequence: Synthetic oligonucleotide
agacagauauuugcauugagaua

SEQ ID NO: 168 - protein, 6 aa, Artificial Sequence
  Description of Artificial Sequence: Synthetic peptide
GGSGGS

SEQ ID NO: 169 - protein, 20 aa, Artificial Sequence
  Description of Artificial Sequence: Synthetic peptide
GSSGSETPGTSESATPESSG

SEQ ID NO: 170 - DNA, 18 bp, Artificial Sequence
  Description of Artificial Sequence: Synthetic oligonucleotide
ggaggctctggaggaagc

SEQ ID NO: 171 - DNA, 60 bp, Artificial Sequence
  Description of Artificial Sequence: Synthetic oligonucleotide
ggctcttctggatctgaaacacctggcacaagcgagagcgccacccctgagagctctggc

SEQ ID NO: 172 - protein, 17 aa, Artificial Sequence
  Description of Artificial Sequence: Synthetic peptide
MAPKKKRKVGIHGVPAA

SEQ ID NO: 173 - DNA, 51 bp, Artificial Sequence
  Description of Artificial Sequence: Synthetic oligonucleotide
atggccccaaagaagaagcggaaggtcggtatccacggagtcccagcagcc

SEQ ID NO: 174 - DNA, 933 bp, Unknown
  Description of Unknown: inactivated kanamycin resistance gene sequence
ccggaattgccagctggggcgccctctggtaaggttgggaagccctgcaaagtaaactggatggctttcttgccgccaaggatctgatggcgcaggggatcaagatctgatcaagagacaggatgaggatcctttcgcatgatcgaataagatggattgcacgcaggttctccggccgcttaggtggagcgcctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcattaactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaa

SEQ ID NO: 175 - RNA, 100 nt, Artificial Sequence
  Description of Artificial Sequence: Synthetic polynucleotide
cuugaccaauagccuugacaguuuuagagcuagaaauagcaaguuaaaauaaggcuaguccguuaucaacuugaaaaaguggcaccgagucggugcuuuu

SEQ ID NO: 176 - RNA, 100 nt, Artificial Sequence; identical to SEQ ID NO: 175
  Description of Artificial Sequence: Synthetic polynucleotide

SEQ ID NO: 177 - DNA, 23 bp, Homo sapiens
cttgaccaatagccttgacaagg

SEQ ID NO: 178 - RNA, 20 nt, Artificial Sequence
  Description of Artificial Sequence: Synthetic oligonucleotide
gaacacaaagcauagacugc

SEQ ID NO: 179 - RNA, 20 nt, Artificial Sequence
  Description of Artificial Sequence: Synthetic oligonucleotide
gggaaagacccagcauccgu

SEQ ID NO: 180 - RNA, 20 nt, Artificial Sequence
  Description of Artificial Sequence: Synthetic oligonucleotide
gcucccaucacaucaaccgg

SEQ ID NO: 181 - RNA, 20 nt, Artificial Sequence
  Description of Artificial Sequence: Synthetic oligonucleotide
ggugagugagugugugcgug

SEQ ID NO: 182 - RNA, 20 nt, Artificial Sequence
  Description of Artificial Sequence: Synthetic oligonucleotide
ggcuucagguucuaaaugag

SEQ ID NO: 183 - RNA, 20 nt, Artificial Sequence
  Description of Artificial Sequence: Synthetic oligonucleotide
gcagagagucgccgucucca

SEQ ID NO: 184 - RNA, 20 nt, Artificial Sequence
  Description of Artificial Sequence: Synthetic oligonucleotide
guguaagaccucaaaagcac

SEQ ID NO: 185 - RNA, 20 nt, Artificial Sequence
  Description of Artificial Sequence: Synthetic oligonucleotide
gaugagaaggagaaguucuu

SEQ ID NO: 186 - RNA, 20 nt, Artificial Sequence
  Description of Artificial Sequence: Synthetic oligonucleotide
gaggacaaaguacaaacggc

SEQ ID NO: 187 - RNA, 20 nt, Artificial Sequence
  Description of Artificial Sequence: Synthetic oligonucleotide
gccaccacagggaagcuggg

SEQ ID NO: 188 - RNA, 20 nt, Artificial Sequence
  Description of Artificial Sequence: Synthetic oligonucleotide
gcucucaggcccuguccgca

SEQ ID NO: 189 - RNA, 20 nt, Artificial Sequence
  Description of Artificial Sequence: Synthetic oligonucleotide
gagcaaauaccagagauaag

SEQ ID NO: 190 - RNA, 20 nt, Artificial Sequence
  Description of Artificial Sequence: Synthetic oligonucleotide
gaucaggaaauagagccaca

SEQ ID NO: 191 - RNA, 20 nt, Artificial Sequence
  Description of Artificial Sequence: Synthetic oligonucleotide
gcccaucccugaguccagcg

SEQ ID NO: 192 - RNA, 23 nt, Artificial Sequence
  Description of Artificial Sequence: Synthetic oligonucleotide
gaacacgaagacaucugaaggua

SEQ ID NO: 193 - RNA, 23 nt, Artificial Sequence
  Description of Artificial Sequence: Synthetic oligonucleotide
gauuuacagccuggccuuugggg

SEQ ID NO: 194 - RNA, 22 nt, Artificial Sequence
  Description of Artificial Sequence: Synthetic oligonucleotide
ggagagaaagagaaguugauug

SEQ ID NO: 195 - RNA, 22 nt, Artificial Sequence
  Description of Artificial Sequence: Synthetic oligonucleotide
gagggugagggaugagauaaug

SEQ ID NO: 196 - RNA, 22 nt, Artificial Sequence
  Description of Artificial Sequence: Synthetic oligonucleotide
gguggaggagggugcauggggu

SEQ ID NO: 197 - RNA, 22 nt, Artificial Sequence
  Description of Artificial Sequence: Synthetic oligonucleotide
gcuguugcaugaggaaagggac

SEQ ID NO: 198 - RNA, 20 nt, Artificial Sequence
  Description of Artificial Sequence: Synthetic oligonucleotide
ggcccagacugagcacguga

SEQ ID NO: 199 - RNA, 20 nt, Artificial Sequence
  Description of Artificial Sequence: Synthetic oligonucleotide
ggcacugcggcuggaggugg

SEQ ID NO: 200 - RNA, 21 nt, Artificial Sequence
  Description of Artificial Sequence: Synthetic oligonucleotide
gcagagcacuggaauucguca

SEQ ID NO: 201 - RNA, 76 nt, Artificial Sequence
  Description of Artificial Sequence: Synthetic oligonucleotide
guuuuagagcuagaaauagcaaguuaaaauaaggcuaguccguuaucaacuugaaaaaguggcaccgagucggugc

SEQ ID NO: 202 - RNA, 84 nt, Artificial Sequence
  Description of Artificial Sequence: Synthetic oligonucleotide
guuuuaguacucuguaaugaaaauuacagaaucuacuaaaacaaggcaaaaugccguguuuaucucgucaacuuguuggcgaga

SEQ ID NO: 203 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnccagccccatctgtcaaact

SEQ ID NO: 204 - DNA, 54 bp, Artificial Sequence
  Description of Artificial Sequence: Synthetic primer
tggagttcagacgtgtgctcttccgatcttgaatggattccttggaaacaatga

SEQ ID NO: 205 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgagggagagccgtgtagtt

SEQ ID NO: 206 - DNA, 49 bp, Artificial Sequence
  Description of Artificial Sequence: Synthetic primer
tggagttcagacgtgtgctcttccgatctgcctctcaaagtgctgggat

SEQ ID NO: 207 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnccatcaggctctcagctcag

SEQ ID NO: 208 - DNA, 48 bp, Artificial Sequence
  Description of Artificial Sequence: Synthetic primer
tggagttcagacgtgtgctcttccgatctctcgtgggtttgtggttgc

SEQ ID NO: 209 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngcccattccctctttagcca

SEQ ID NO: 210 - DNA, 49 bp, Artificial Sequence
  Description of Artificial Sequence: Synthetic primer
tggagttcagacgtgtgctcttccgatctgagccgttccctctttgcta

SEQ ID NO: 211 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnaacctgtgtgacacttggca

SEQ ID NO: 212 - DNA, 49 bp, Artificial Sequence
  Description of Artificial Sequence: Synthetic primer
tggagttcagacgtgtgctcttccgatctgtctggcccaagatcacaca

SEQ ID NO: 213 - DNA, 56 bp, Artificial Sequence
  Description of Artificial Sequence: Synthetic primer
  modified_base (34)..(36): a, c, t, g, unknown or other
acactctttccctacacgacgctcttccgatctnnncacggataaagacgctggga

SEQ ID NO: 214 - DNA, 47 bp, Artificial Sequence
  Description of Artificial Sequence: Synthetic primer
tggagttcagacgtgtgctcttccgatctggggtcccaggtgctgac

SEQ ID NO: 215 - DNA, 56 bp, Artificial Sequence
  Description of Artificial Sequence: Synthetic primer
  modified_base (34)..(36): a, c, t, g, unknown or other
acactctttccctacacgacgctcttccgatctnnnttgattgtctcctttgccgc

SEQ ID NO: 216 - DNA, 53 bp, Artificial Sequence
  Description of Artificial Sequence: Synthetic primer
tggagttcagacgtgtgctcttccgatcttgacccagtgtttgatagatcagt

SEQ ID NO: 217 - DNA, 56 bp, Artificial Sequence
  Description of Artificial Sequence: Synthetic primer
  modified_base (34)..(36): a, c, t, g, unknown or other
acactctttccctacacgacgctcttccgatctnnncaccccttcagtccatgctt

SEQ ID NO: 218 - DNA, 49 bp, Artificial Sequence
  Description of Artificial Sequence: Synthetic primer
tggagttcagacgtgtgctcttccgatcttctgatggggaggaacgagt

SEQ ID NO: 219 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncagctcagcctgagtgttga

SEQ ID NO: 220 - DNA, 49 bp, Artificial Sequence
  Description of Artificial Sequence: Synthetic primer
tggagttcagacgtgtgctcttccgatctgcccaccctagtcattggag

SEQ ID NO: 221 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngtcagagggacacactgtgg

SEQ ID NO: 222 - DNA, 49 bp, Artificial Sequence
  Description of Artificial Sequence: Synthetic primer
tggagttcagacgtgtgctcttccgatctcacactcactcacccacaca

SEQ ID NO: 223 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgtgtgggtgagtgagtgtg

SEQ ID NO: 224 - DNA, 49 bp, Artificial Sequence
  Description of Artificial Sequence: Synthetic primer
tggagttcagacgtgtgctcttccgatctcaccaaggttcacagcctga

SEQ ID NO: 225 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnttgtctctgcctgtagctgc

SEQ ID NO: 226 - DNA, 49 bp, Artificial Sequence
  Description of Artificial Sequence: Synthetic primer
tggagttcagacgtgtgctcttccgatctcgctctgggcttcatcttca

SEQ ID NO: 227 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgggattatgggtgtgagcc

SEQ ID NO: 228 - DNA, 49 bp, Artificial Sequence
  Description of Artificial Sequence: Synthetic primer
tggagttcagacgtgtgctcttccgatcttgccttcctcctctctctcc

SEQ ID NO: 229 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgcagaccagattcggagaa

SEQ ID NO: 230 - DNA, 49 bp, Artificial Sequence
  Description of Artificial Sequence: Synthetic primer
tggagttcagacgtgtgctcttccgatctgttcagtttccagggggtcc

SEQ ID NO: 231 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntccgcacagccttagttcaa

SEQ ID NO: 232 - DNA, 49 bp, Artificial Sequence
  Description of Artificial Sequence: Synthetic primer
tggagttcagacgtgtgctcttccgatctaacttgaagagacggcagca

SEQ ID NO: 233 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncccccagctacagaaaggtc

SEQ ID NO: 234 - DNA, 49 bp, Artificial Sequence
  Description of Artificial Sequence: Synthetic primer
tggagttcagacgtgtgctcttccgatctatttccaccgcaaaatggcc

SEQ ID NO: 235 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntcacttcagcccaggagtat

SEQ ID NO: 236 - DNA, 51 bp, Artificial Sequence
  Description of Artificial Sequence: Synthetic primer
tggagttcagacgtgtgctcttccgatcttgtgtatggtgagaggtaggga

SEQ ID NO: 237 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngtctgaggtcacacagtggg

SEQ ID NO: 238 - DNA, 49 bp, Artificial Sequence
  Description of Artificial Sequence: Synthetic primer
tggagttcagacgtgtgctcttccgatctctgagagcagggaccacatc

SEQ ID NO: 239 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngggaggtggagagaggatgt

SEQ ID NO: 240 - DNA, 54 bp, Artificial Sequence
  Description of Artificial Sequence: Synthetic primer
tggagttcagacgtgtgctcttccgatctactcttcctgaggtctaggaacccg

SEQ ID NO: 241 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnccctgttcctaaagcccacc

SEQ ID NO: 242 - DNA, 53 bp, Artificial Sequence
  Description of Artificial Sequence: Synthetic primer
tggagttcagacgtgtgctcttccgatctactctctggttctgtttgtggcca

SEQ ID NO: 243 - DNA, 60 bp, Artificial Sequence
  Description of Artificial Sequence: Synthetic primer
  modified_base (34)..(37): a, c, t, g, unknown or other
acactctttccctacacgacgctcttccgatctnnnnatttgatggagttggacatggcc

SEQ ID NO: 244 - DNA, 46 bp, Artificial Sequence
  Description of Artificial Sequence: Synthetic primer
tggagttcagacgtgtgctctccagctacttgttcttgagtgaagg

SEQ ID NO: 245 - DNA, 59 bp, Artificial Sequence
  Description of Artificial Sequence: Synthetic primer
  modified_base (34)..(37): a, c, t, g, unknown or other
acactctttccctacacgacgctcttccgatctnnnntggctttccaaatcagtgggtc

SEQ ID NO: 246 - DNA, 52 bp, Artificial Sequence
  Description of Artificial Sequence: Synthetic primer
tggagttcagacgtgtgctcttccgatctctcataagcttagaccaacaagc

SEQ ID NO: 247 - DNA, 58 bp, Artificial Sequence
  Description of Artificial Sequence: Synthetic primer
  modified_base (34)..(37): a, c, t, g, unknown or other
acactctttccctacacgacgctcttccgatctnnnnctggttgaccaatctgtggtg

SEQ ID NO: 248 - DNA, 41 bp, Artificial Sequence
  Description of Artificial Sequence: Synthetic primer
tggagttcagacgtgtgctctctgcgtctggatcaggtacg

SEQ ID NO: 249 - DNA, 58 bp, Artificial Sequence
  Description of Artificial Sequence: Synthetic primer
  modified_base (34)..(37): a, c, t, g, unknown or other
acactctttccctacacgacgctcttccgatctnnnngtgtggagagtgagtaagcca

SEQ ID NO: 250 - DNA, 50 bp, Artificial Sequence
  Description of Artificial Sequence: Synthetic primer
tggagttcagacgtgtgctcttccgatctacggtaggatgatttcaggca

SEQ ID NO: 251 - DNA, 58 bp, Artificial Sequence
  Description of Artificial Sequence: Synthetic primer
  modified_base (34)..(37): a, c, t, g, unknown or other
acactctttccctacacgacgctcttccgatctnnnncacaaagcagtgtagctcagg

SEQ ID NO: 252 - DNA, 54 bp, Artificial Sequence
  Description of Artificial Sequence: Synthetic primer
tggagttcagacgtgtgctcttccgatcttttttggtactcgagtgttattcag

SEQ ID NO: 253 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntcccctgttgacctggagaa

SEQ ID NO: 254 - DNA, 49 bp, Artificial Sequence
  Description of Artificial Sequence: Synthetic primer
tggagttcagacgtgtgctcttccgatctcactgtacttgccctgacca

SEQ ID NO: 255 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnttggtgttgacagggagcaa

SEQ ID NO: 256 - DNA, 49 bp, Artificial Sequence
  Description of Artificial Sequence: Synthetic primer
tggagttcagacgtgtgctcttccgatctctgagatgtgggcagaaggg

SEQ ID NO: 257 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntgagagggaacagaagggct

SEQ ID NO: 258 - DNA, 49 bp, Artificial Sequence
  Description of Artificial Sequence: Synthetic primer
tggagttcagacgtgtgctcttccgatctgtccaaaggcccaagaacct

SEQ ID NO: 259 - DNA, 58 bp, Artificial Sequence
  Description of Artificial Sequence: Synthetic primer
  modified_base (34)..(37): a, c, t, g, unknown or other
acactctttccctacacgacgctcttccgatctnnnntcctagcactttggaaggtcg

SEQ ID NO: 260 - DNA, 51 bp, Artificial Sequence
  Description of Artificial Sequence: Synthetic primer
tggagttcagacgtgtgctcttccgatctgctcatcttaatctgctcagcc

SEQ ID NO: 261 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnaaaggagcagctcttcctgg

SEQ ID NO: 262 - DNA, 49 bp, Artificial Sequence
  Description of Artificial Sequence: Synthetic primer
tggagttcagacgtgtgctcttccgatctgtctgcaccatctcccacaa

SEQ ID NO: 263 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnggcatggcttctgagactca

SEQ ID NO: 264 - DNA, 53 bp, Artificial Sequence
  Description of Artificial Sequence: Synthetic primer
tggagttcagacgtgtgctcttccgatctgtctcccttgcactccctgtcttt

SEQ ID NO: 265 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntttggcaatggaggcattgg

SEQ ID NO: 266 - DNA, 49 bp, Artificial Sequence
  Description of Artificial Sequence: Synthetic primer
tggagttcagacgtgtgctcttccgatctgaagaggctgcccatgagag

SEQ ID NO: 267 - DNA, 57 bp, Artificial Sequence
  Description of Artificial Sequence: Synthetic primer
  modified_base (34)..(37): a, c, t, g, unknown or other
acactctttccctacacgacgctcttccgatctnnnnggtctgaggctcgaatcctg

SEQ ID NO: 268 - DNA, 49 bp, Artificial Sequence
  Description of Artificial Sequence: Synthetic primer
tggagttcagacgtgtgctcttccgatctctgtggcctccatatccctg

SEQ ID NO: 269 - DNA, 57 bp, Artificial Sequence
  Description of Artificial Sequence: Synthetic primer
  modified_base (34)..(37): a, c, t, g, unknown or other
acactctttccctacacgacgctcttccgatctnnnntttccaccagaactcagccc

SEQ ID NO: 270 - DNA, 49 bp, Artificial Sequence
  Description of Artificial Sequence: Synthetic primer
tggagttcagacgtgtgctcttccgatctcctcggttcctccacaacac

SEQ ID NO: 271 - DNA, 57 bp, Artificial Sequence
  Description of Artificial Sequence: Synthetic primer
  modified_base (34)..(37): a, c, t, g, unknown or other
acactctttccctacacgacgctcttccgatctnnnncacgggaaggacaggagaag

SEQ ID NO: 272 - DNA, 49 bp, Artificial Sequence
  Description of Artificial Sequence: Synthetic primer
tggagttcagacgtgtgctcttccgatctgcaggggagggataaagcag

SEQ ID NO: 273 - DNA, 59 bp, Artificial Sequence
  Description of Artificial Sequence: Synthetic primer
  modified_base (34)..(37): a, c, t, g, unknown or other
acactctttccctacacgacgctcttccgatctnnnnggaaacgcccatgcaattagtc

SEQ ID NO: 274 - DNA, 51 bp, Artificial Sequence
  Description of Artificial Sequence: Synthetic primer
tggagttcagacgtgtgctcttccgatctcttgtcaaccagtatcccggtg

SEQ ID NO: 275 - DNA, 61 bp, Artificial Sequence
  Description of Artificial Sequence: Synthetic primer
  modified_base (34)..(37): a, c, t, g, unknown or other
acactctttccctacacgacgctcttccgatctnnnntgaatggattccttggaaacaatg

SEQ ID NO: 276 - DNA, 49 bp, Artificial Sequence
  Description of Artificial Sequence: Synthetic primer
tggagttcagacgtgtgctcttccgatctccagccccatctgtcaaact

SEQ ID NO: 277 - DNA, 49 bp, Artificial Sequence
  Description of Artificial Sequence: Synthetic primer
tggagttcagacgtgtgctcttccgatcttcctttcaacccgaacggag

SEQ ID NO: 278 - DNA, 57 bp, Artificial Sequence
  Description of Artificial Sequence: Synthetic primer
  modified_base (34)..(37): a, c, t, g, unknown or other
acactctttccctacacgacgctcttccgatctnnnngctggtcttctttcccctcc

SEQ ID NO: 279 - DNA, 59 bp, Artificial Sequence
  Description of Artificial Sequence: Synthetic primer
  modified_base (34)..(37): a, c, t, g, unknown or other
acactctttccctacacgacgctcttccgatctnnnngccctgcttctttttctctggt

SEQ ID NO: 280 - DNA, 51 bp, Artificial Sequence
  Description of Artificial Sequence: Synthetic primer
tggagttcagacgtgtgctcttccgatctaccattaacgcagccaacttca

SEQ ID NO: 281 - DNA, 60 bp, Artificial Sequence
  Description of Artificial Sequence: Synthetic primer
acactctttccctacacgacgctcttccgatctcatgaggtctatggacttcaagagcaa

SEQ ID NO: 282 - DNA, 56 bp, Artificial Sequence
  Description of Artificial Sequence: Synthetic primer
tggagttcagacgtgtgctcttccgatctcatcattgaccagagctctgggcagaa

SEQ ID NO: 283 - DNA, 60 bp, Artificial Sequence
  Description of Artificial Sequence: Synthetic primer
acactctttccctacacgacgctcttccgatctgcacttaccagcattacttcctaaacc

SEQ ID NO: 284 - DNA, 55 bp, Artificial Sequence
  Description of Artificial Sequence: Synthetic primer
tggagttcagacgtgtgctcttccgatctatgggctccacttttcagctctgtaa

SEQ ID NO: 285 - DNA, 57 bp, Artificial Sequence
  Description of Artificial Sequence: Synthetic primer
acactctttccctacacgacgctcttccgatctcagttcaggcacatgtaggaggga

SEQ ID NO: 286 - DNA, 56 bp, Artificial Sequence
  Description of Artificial Sequence: Synthetic primer
tggagttcagacgtgtgctcttccgatctaccgcctgcagctgtcggacactggca

SEQ ID NO: 287 - DNA, 56 bp, Artificial Sequence
  Description of Artificial Sequence: Synthetic primer
acactctttccctacacgacgctcttccgatctaaaagatgagtatgcctgccgtg

SEQ ID NO: 288 - DNA, 56 bp, Artificial Sequence
  Description of Artificial Sequence: Synthetic primer
tggagttcagacgtgtgctcttccgatctcagattgtttatatcagatgggatggg

SEQ ID NO: 289 - DNA, 59 bp, Artificial Sequence
  Description of Artificial Sequence: Synthetic primer
acactctttccctacacgacgctcttccgatctatgcaagtttggtcctgagccctccc

SEQ ID NO: 290 - DNA, 53 bp, Artificial Sequence
  Description of Artificial Sequence: Synthetic primer
tggagttcagacgtgtgctcttccgatctgatgtgggttccctgcgctctgca

SEQ ID NO: 291 - DNA, 57 bp, Artificial Sequence
  Description of Artificial Sequence: Synthetic primer
acactctttccctacacgacgctcttccgatctccagggactgagggtggaaggtcc

SEQ ID NO: 292 - DNA, 52 bp, Artificial Sequence
  Description of Artificial Sequence: Synthetic primer
tggagttcagacgtgtgctcttccgatctacctccgcctgagcagtggagaa

SEQ ID NO: 293 - DNA, 27 bp, Artificial Sequence
  Description of Artificial Sequence: Synthetic primer
tcgagctcggtacctaatacgactcac

SEQ ID NO: 294 - DNA, 149 bp, Artificial Sequence
  Description of Artificial Sequence: Synthetic primer
ttttttttttttttttttttttttttttttttttttttttttttttttttttttttttttttttttttttttttttttttttttttttttttttttttttttttttttttttttttttttcttcctactcaggctttattcaaagacca

SEQ ID NO: 295 - DNA, 13 bp, Homo sapiens
ttgaccaatagcc

SEQ ID NO: 296 - DNA, 67 bp, Homo sapiens
tggctaaactccacccatgggttggccagccttgccttgaccaatagccttgacaaggcaaacttga

SEQ ID NO: 297 - protein, 8 aa, Artificial Sequence
  Description of Artificial Sequence: Synthetic peptide
  MOD_RES (5)..(5): Val or Ala
  MOD_RES (8)..(8): Ser or Pro
HLTPXEKX

SEQ ID NO: 298 - DNA, 25 bp, Artificial Sequence
  Description of Artificial Sequence: Synthetic oligonucleotide
gcatctgactcctgtggagaagtct

SEQ ID NO: 299 - DNA, 25 bp, Artificial Sequence
  Description of Artificial Sequence: Synthetic oligonucleotide
agacttctccacaggagtcagatgc

SEQ ID NO: 300 - protein, 8 aa, Artificial Sequence
  Description of Artificial Sequence: Synthetic peptide
HLTPVEKS

SEQ ID NO: 301 - DNA, 21 bp, Artificial Sequence
  Description of Artificial Sequence: Synthetic oligonucleotide
acttctcaaggagtcaggtgc

SEQ ID NO: 302 - protein, 9 aa, Artificial Sequence
  Description of Artificial Sequence: Synthetic peptide
VHLTPVEKS

SEQ ID NO: 303 - DNA, 20 bp, Artificial Sequence
  Description of Artificial Sequence: Synthetic oligonucleotide
gaacacaaagcatagactgc

SEQ ID NO: 304 - DNA, 20 bp, Artificial Sequence
  Description of Artificial Sequence: Synthetic oligonucleotide
ggacagcttttcctagacag

SEQ ID NO: 305 - protein, 8 aa, Artificial Sequence
  Description of Artificial Sequence: Synthetic peptide
  MOD_RES (5)..(5): Val or Ala
  MOD_RES (8)..(8): Ser or Pro
HLTPXEKX

SEQ ID NO: 306 - DNA, 25 bp, Artificial Sequence
  Description of Artificial Sequence: Synthetic oligonucleotide
  modified_base (10)..(10): t or c
  modified_base (13)..(13): t or c
  modified_base (15)..(15): t or c
  modified_base (23)..(23): t or c
gcacctgacnccngnggagaagnct

SEQ ID NO: 307 - DNA, 25 bp, Artificial Sequence
  Description of Artificial Sequence: Synthetic oligonucleotide
  modified_base (3)..(3): a or g
  modified_base (11)..(11): a or g
  modified_base (13)..(13): a or g
  modified_base (16)..(16): a or g
agncttctccncnggngtcaggtgc

SEQ ID NO: 308 - RNA, 101 nt, Artificial Sequence
  Description of Artificial Sequence: Synthetic polynucleotide
gacuucuccacaggagucaggguuuuagagcuagaaauagcaaguuaaaauaaggcuaguccguuaucaacuugaaaaaguggcaccgagucggugcuuuu

SEQ ID NO: 309 - RNA, 100 nt, Artificial Sequence
  Description of Artificial Sequence: Synthetic polynucleotide
acuucuccacaggagucaggguuuuagagcuagaaauagcaaguuaaaauaaggcuaguccguuaucaacuugaaaaaguggcaccgagucggugcuuuu

SEQ ID NO: 310 - RNA, 99 nt, Artificial Sequence
  Description of Artificial Sequence: Synthetic oligonucleotide
cuucuccacaggagucaggguuuuagagcuagaaauagcaaguuaaaauaaggcuaguccguuaucaacuugaaaaaguggcaccgagucggugcuuuu

What is claimed is:

1. A method for editing a beta globin (HBB) polynucleotide associated with sickle cell disease, the method comprising contacting a cell comprising a single nucleotide polymorphism (SNP) in the beta globin (HBB) polynucleotide with a guide RNA and a fusion protein comprising a polynucleotide programmable DNA binding domain and an adenosine deaminase domain comprising a serine (S) at amino acid position 82 of the following amino acid sequence and having at least 85% sequence identity to the following amino acid sequence (SEQ ID NO: 2)
MSEVEFSHEYWMRHALTLAKRARDEREVPVGAVLVLNNRVIGEGWNR

AIGLHDPTAHAEIMALRQGGLVMQNYRLIDATLYVTFEPCVMCAGAM

IHSRIGRVVFGVRNAKTGAAGSLMDVLHYPGMNHRVEITEGILADEC

AALLCYFFRMPRQVFNAQKKAQSSTD, wherein said guide RNA targets said polynucleotide programmable DNA binding domain to the SNP in the beta globin (HBB) polynucleotide.

2. The method of claim 1, wherein the adenosine deaminase domain further comprises an alteration at amino acid position 166.

3. The method of claim 2, wherein the alteration at amino acid position 166 is T166R.

4. The method of claim 1, wherein the adenosine deaminase domain further comprises one or more of the following alterations: Y147T, Y147R, Q154S, Y123H, and Q154R.

5. The method of claim 1, wherein the adenosine deaminase domain comprises a combination of alterations selected from the group consisting of:
Y147T and Q154R;
Y147T and Q154S;
Y147R and Q154S;
V82S and Q154S;
V82S and Y147R;
V82S and Q154R;
V82S and Y123H;
I76Y and V82S;
V82S, Y123H, and Y147T;
V82S, Y123H, and Y147R;
V82S, Y123H, and Q154R;
Y147R, Q154R, and Y123H;

Y147R, Q154R, and I76Y;
Y147R, Q154R, and T166R;
Y123H, Y147R, Q154R, and I76Y;
V82S, Y123H, Y147R, and Q154R; and
I76Y, V82S, Y123H, Y147R, and Q154R.

6. The method of claim 1, wherein the adenosine deaminase domain comprises V82S and T166R.

7. The method of claim 1, wherein the fusion protein comprises a heterodimer comprising the adenosine deaminase domain of claim 1 and a wild-type adenosine deaminase domain.

8. The method of claim 1, wherein the adenosine deaminase domain comprises Y147T and Q154S.

9. The method of claim 1, wherein an A•T to G•C alteration at the SNP results in expression of an HBB polypeptide having an alanine at amino acid position 6.

10. The method of claim 1, wherein the programmable DNA binding domain comprises a Cas9 domain.

11. The method of claim 10, wherein the Cas9 domain comprises a dead Cas9 (dCas9) or a nickase Cas9 (nCas9).

12. The method of claim 11, wherein the Cas9 domain is capable of programmable DNA binding and has at least 85% amino acid sequence identity to a *Streptococcus pyogenes* Cas9 (SpCas9), *Staphylococcus aureus* Cas9 (SaCas9), or a *Streptococcus thermophilus* 1 Cas9 (St1Cas9).

13. The method of claim 11, wherein the Cas9 domain comprises the following amino acid sequence:

```
                                        (SEQ ID NO: 1)
MDKKYSIGLDIGTNSVGWAVITDEYKVPSKKFKVLGNTDRHSIKKNLIG

ALLFDSGETAEATRLKRTARRRYTRRKNRICYLQEIFSNEMAKVDDSFF

HRLEESFLVEEDKKHERHPIFGNIVDEVAYHEKYPTIYHLRKKLVDSTD

KADLRLIYLALAHMIKFRGHFLIEGDLNPDNSDVDKLFIQLVQTYNQLF

EENPINASGVDAKAILSARLSKSRRLENLIAQLPGEKKNGLFGNLIALS

LGLTPNFKSNFDLAEDAKLQLSKDTYDDDLDNLLAQIGDQYADLFLAAK

NLSDAILLSDILRVNTEITKAPLSASMIKRYDEHHQDLTLLKALVRQQL

PEKYKEIFFDQSKNGYAGYIDGGASQEEFYKFIKPILEKMDGTEELLVK

LNREDLLRKQRTEDNGSIPHQIHLGELHAILRRQEDFYPFLKDNREKIE

KILTFRIPYYVGPLARGNSRFAWMTRKSEETITPWNFEEVVDKGASAQS

FIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFN

ASLGTYHDLLKIIKDKDFLDNEENEDILEDIVLTLTLFEDREMIEERLK

TYAHLFDDKVMKQLKRRRYTGWGRLSRKLINGIRDKQSGKTILDFLKSD

GFANRNFMQLIHDDSLTFKEDIQKAQVSGQGDSLHEHIANLAGSPAIKK

GILQTVKVVDELVKVMGRHKPENIVIEMARENQTTQKGQKNSRERMKRI

EEGIKELGSQILKEHPVENTQLQNEKLYLYYLQNGRDMYVDQELDINRL

SDYDVDHIVPQSFLKDDSIDNKVLTRSDKNRGKSDNVPSEEVVKKMKNY

WRQLLNAKLITQRKFDNLTKAERGGLSELDKAGFIKRQLVETRQITKHV

AQILDSRMNTKYDENDKLIREVKVITLKSKLVSDFRKDFQFYKVREINN

YHHAHDAYLNAVVGTALIKKYPKLESEFVYGDYKVYDVRKMIAKSEQEI

GKATAKYFFYSNIMNFEKTEITLANGEIRKRPLIETNGETGEIVWDKGR

DFATVRKVLSMPQVNIVKKTEVQTGGFSKESILPKRNSDKLIARKKDWD
```

```
PKKYGGFDSPTVAYSVLVVAKVEKGKSKKLKSVKELLGITIMERSSFEK

NPIDFLEAKGYKEVKKDLIIKLPKYSLFELENGRKRMLASAGELQKGNE

LALPSKYVNFLYLASHYEKLKGSPEDNEQKQLFVEQHKHYLDEIIEQIS

EFSKRVILADANLDKVLSAYNKHRDKPIREQAENIIHLFTLTNLGAPAA

FKYFDTTIDRKRYTSTKEVLDATLIHQSITGLYETRIDLSQLGGD.
```

14. The method of claim 1, wherein the fusion protein is selected from ABE8.14-m, ABE8.15-m, ABE8.16-m, ABE8.17-m, ABE8.18-m, ABE8.19-m, ABE8.20-m, ABE8.22-m, ABE8.23-m, ABE8.24-m, ABE8.14-d, ABE8.15-d, ABE8.16-d, ABE8.17-d, ABE8.18-d, ABE8.19-d, ABE8.20-d, ABE8.22-d, ABE8.23-d, or ABE8.24-d.

15. The method of claim 1 wherein the adenosine deaminase domain comprises a truncated TadA8 comprising a deletion of 1, 2, 3, 4, 5,6, 7, or 8 N-terminal or C-terminal amino acid residues relative to the full length TadA8.

16. The method of claim 1, wherein the adenosine deaminase domain has at least 90% sequence identity to the amino acid sequence.

17. A base editing system comprising the fusion protein of claim 1 and a guide RNA comprising a nucleic acid sequence selected from the group consisting of

```
                         (SEQ ID NO: 4)
CUUCUCCACAGGAGUCAGAU;

(SEQ ID NO: 5)
ACUUCUCCACAGGAGUCAGAU;
and (SEQ ID NO: 6)
GACUUCUCCACAGGAGUCAGAU.
```

18. A method for editing a beta globin (HBB) polynucleotide associated with sickle cell disease, the method comprising contacting a cell comprising a single nucleotide polymorphism (SNP) in the beta globin (HBB) polynucleotide with a guide RNA and a fusion protein comprising a polynucleotide programmable DNA binding domain comprising the following amino acid sequence:

```
                                        (SEQ ID NO: 3)
EIGKATAKYFFYSNIMNFFKTEITLANGEIRKRPLIETNGETGEIVWDK

GRDFATVRKVLSMPQVNIVKKTEVQTGGFSKESILPKRNSDKLIARKKD

WDPKKYGGFMQPTVAYSVLVVAKVEKGKSKKLKSVKELLGITIMERSSF

EKNPIDFLEAKGYKEVKKDLIIKLPKYSLFELENGRKRMLASAKFLQKG

NELALPSKYVNFLYLASHYEKLKGSPEDNEQKQLFVEQHKHYLDEIIEQ

ISEFSKRVILADANLDKVLSAYNKHRDKPIREQAENIIHLFTLTNLGAP

RAFKYFDTTIARKEYRSTKEVLDATLIHQSITGLYETRIDLSQLGGDGG

SGGSGGSGGSGGSGGSGGMDKKYSIGLAIGTNSVGWAVITDEYKVPSKK

FKVLGNTDRHSIKKNLIGALLFDSGETAEATRLKRTARRRYTRRKNRIC

YLQEIFSNEMAKVDDSFFHRLEESFLVEEDKKHERHPIFGNIVDEVAYH

EKYPTIYHLRKKLVDSTDKADLRLIYLALAHMIKFRGHFLIEGDLNPDN

SDVDKLFIQLVQTYNQLFEENPINASGVDAKAILSARLSKSRRLENLIA

QLPGEKKNGLFGNLIALSLGLTPNFKSNFDLAEDAKLQLSKDTYDDDLD
```

-continued

NLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYK

FIKPILEKMDGTEELLVKLNREDLLRKQRTFDNGSIPHQIHLGELHAIL

RRQEDFYPFLKDNREKIEKILTFRIPYYVGPLARGNSRFAWMTRKSEET

ITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFK

KIECFDSVEISGVEDRFNASLGTYHDLLKIIKDKDFLDNEENEDILEDI

VLTLTLFEDREMIEERLKTYAHLFDDKVMKQLKRRRYTGWGRLSRKLIN

GIRDKQSGKTILDFLKSDGFANRNFMQLIHDDSLTFKEDIQKAQVSGQG

DSLHEHIANLAGSPAIKKGILQTVKVVDELVKVMGRHKPENIVIEMARE

NQTTQKGQKNSRERMKRIEEGIKELGSQILKEHPVENTQLQNEKLYLYY

LQNGRDMYVDQELDINRLSDYDVDHIVPQSFLKDDSIDNKVLTRSDKNR

GKSDNVPSEEVVKKMKNYWRQLLNAKLITQRKFDNLTKAERGGLSELDK

AGFIKRQLVETRQITKHVAQILDSRMNTKYDENDKLIREVKVITLKSKL

VSDFRKDFQFYKVREINNYHHAHDAYLNAVVGTALIKKYPKLESEFVYG

DYKVYDVRKMIAKSEQEGADKRTADGSEFESPKKKRKV, and at an adenosine deaminase domain comprising a serine (S) at amino acid position 82 of the following amino acid sequence and having at least 85% sequence identity to the following amino acid sequence
MSEVEFSHEYWMRHALTLAKRAR-
DEREVPVGAVLVLNNRVIGEGWNRAIGLHDPTAHAEI
MALRQGGLVMQNYRLIDATLYVTFEPCVMCAG-
AMIHSRIGRVVFGVRNAKTGAAGSLMD VLHY-
PGMNHRVEITEGILADECAALLCYFFRM-
PRQVFNAQKKAQSSTD (SEQ ID NO: 2).

19. A cell or a progenitor thereof, comprising:
a fusion protein comprising a polynucleotide programmable DNA binding domain and an adenosine deaminase domain described in claim 1 or a polynucleotide encoding said fusion protein; and
one or more guide polynucleotides that target the fusion protein to effect an A•T to G•C alteration of the SNP in the HBB polynucleotide.

20. The cell of claim 19, wherein the cell is a hematopoietic stem cell, a common myeloid progenitor, proerythroblast, erythroblast, reticulocyte, or erythrocyte.

21. The cell of claim 19, wherein the cell is a mammalian cell or a human cell.

22. A method of treating sickle cell disease in a subject comprising administering to said subject a cell comprising:
a fusion protein comprising a polynucleotide programmable DNA binding domain and an adenosine deaminase domain described in claim 1 or a polynucleotide encoding said fusion protein; and
one or more guide polynucleotides that target the fusion protein to effect an A•T to G•C alteration of the SNP in the HBB polynucleotide.

23. A population of cells comprising:
a fusion protein comprising the polynucleotide programmable DNA binding domain and the adenosine deaminase domain described in claim 1 or a polynucleotide encoding said fusion protein; and
one or more guide polynucleotides that target the fusion protein to effect an A•T to G•C alteration of the SNP in the HBB polynucleotide.

24. A method of producing a red blood cell, or progenitor thereof, comprising:
(a) introducing into a red blood cell progenitor comprising an HBB polynucleotide associated with sickle cell disease:
i) a fusion protein, or a polynucleotide encoding said fusion protein, wherein said fusion protein comprises a polynucleotide-programmable nucleotide-binding domain and an adenosine deaminase domain described in claim 1; and
ii) one or more guide polynucleotides, wherein said one or more guide polynucleotides target said fusion protein to effect an A•T to G•C alteration of an SNP in the HBB polynucleotide; and
(b) differentiating the red blood cell progenitor into a red blood cell.

25. A method for treating sickle cell disease (SCD) in a subject, the method comprising: administering to the subject the fusion protein described in claim 1, or a polynucleotide encoding the fusion protein; and a guide polynucleotide to target the fusion protein to effect an A•T to G•C alteration of a single nucleotide polymorphism (SNP) associated with SCD, thereby treating SCD in the subject.

26. The method of claim 25, wherein the guide polynucleotide is a guide RNA.

27. The method of claim 26, wherein the alteration of the SNP replaces a target nucleobase with a non-wild type nucleobase, and wherein the alteration of the target nucleobase ameliorates symptoms of sickle cell disease.

28. A pharmaceutical composition comprising a base editing system comprising the fusion protein of claim 1, a guide RNA, and a pharmaceutically acceptable carrier, vehicle, or excipient.

29. A base editor system comprising a fusion protein comprising a polynucleotide programmable DNA binding domain and an adenosine deaminase domain comprising a serine (S) at amino acid position 82 of the following amino acid sequence and having at least 85% sequence identity to the following amino acid sequence (SEQ ID NO: 2)
MSEVEFSHEYWMRHALTLAKRARDEREVPVGAVLVLNNRVIGEGWNR

AIGLHDPTAHAEIMALRQGGLVMQNYRLIDATLYVTFEPCVMCAGAM

IHSRIGRVVFGVRNAKTGAAGSLMDVLHYPGMNHRVEITEGILADEC

AALLCYFFRMPRQVFNAQKKAQSSTD and a guide RNA, wherein said guide RNA targets said fusion protein to effect an alteration of a single nucleotide polymorphism (SNP) in a beta globin (HBB) polynucleotide.

30. The base editor system of claim 29, wherein the programmable DNA binding domain comprises the following amino acid sequence:

(SEQ ID NO: 3)
EIGKATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFMQPTVAYSVLVVAKV

-continued

EKGKSKKLKSVKELLGITIMERSSFEKNPIDFLEAKGYKEVKKDLIIKLPKYSLFELENGRKR

MLASAKFLQKGNELALPSKYVNFLYLASHYEKLKGSPEDNEQKQLFVEQHKHYLDEIIEQI

SEFSKRVILADANLDKVLSAYNKHRDKPIREQAENIIHLFTLTNLGAPRAFKYFDTTIARKEY

RSTKEVLDATLIHQSITGLYETRIDLSQLGGDGGSGGSGGSGGSGGSGGSGGMDKKYSIGL

AIGTNSVGWAVITDEYKVPSKKFKVLGNTDRHSIKKNLIGALLFDSGETAEATRLKRTARR

RYTRRKNRICYLQEIFSNEMAKVDDSFFHRLEESFLVEEDKKHERHPIFGNIVDEVAYHEKY

PTIYHLRKKLVDSTDKADLRLIYLALAHMIKFRGHFLIEGDLNPDNSDVDKLFIQLVQTYNQ

LFEENPINASGVDAKAILSARLSKSRRLENLIAQLPGEKKNGLFGNLIALSLGLTPNFKSNFD

LAEDAKLQLSKDTYDDDLDNLLAQIGDQYADLFLAAKNLSDAILLSDILRVNTEITKAPLSA

SMIKRYDEHHQDLTLLKALVRQQLPEKYKEIFFDQSKNGYAGYIDGGASQEEFYKFIKPILE

KMDGTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDKNLPN

EKVLPKHSLLYEYFTVYNELTKVKYVTEGMRKPAFLSGEQKKAIVDLLFKTNRKVTVKQL

KEDYFKKIECFDSVEISGVEDRFNASLGTYHDLLKIIKDKDFLDNEENEDILEDIVLTLTLFED

REMIEERLKTYAHLFDDKVMKQLKRRRYTGWGRLSRKLINGIRDKQSGKTILDFLKSDGFA

NRNFMQLIHDDSLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHPVENTQLQNEKL

YLYYLQNGRDMYVDQELDINRLSDYDVDHIVPQSFLKDDSIDNKVLTRSDKNRGKSDNVP

SEEVVKKMKNYWRQLLNAKLITQRKFDNLTKAERGGLSELDKAGFIKRQLVETRQITKHV

AQILDSRMNTKYDENDKLIREVKVITLKSKLVSDFRKDFQFYKVREINNYHHAHDAYLNA

VVGTALIKKYPKLESEFVYGDYKVYDVRKMIAKSEQEGADKRTADGSEFESPKKKRKV.

\* \* \* \* \*